United States Patent 11,549,145 (METHODS AND COMPOSITIONS FOR INHIBITING AND TREATING NEUROLOGICAL CONDITIONS) - sequence listing, part 143

SEQ ID NO: 2623 - DNA, 581896 bp, Homo sapiens
cgcagcgcgcaccgagccggccgcgccgcgcccgccgctctcgccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtgagtggcaccacggcagagtccccggctggtgcttgaggaaagccctgggaattgggggccaccggtcctcaggatgcgccgcggtattcccttctcgggttccgcaggttaacagcatctcagtccggactctgatgccacttgccttgcatctcgcagcccggagaccggtgggtttaagggaaccttcgtcagaagttgggtgctaggtcatctttgtggcatgcagaccctgacatttggctaggcaaactgaggcgagcggtcggtggcgtgattctctcccgcccccaaacacacccagtttatgttggagccgagctatgaatgaaaagtttgtactggcaacgtgttgcttgaggggagcaacgcttattggggggtacctttgatgtttcgtggaggacttcagttttaagtcaatacatcagaatcctgggttttaagaaaagttcaggaggctgggggatgggatgggagataaagcagttccttgactagtggaaggagagtgatgaatcgtaagcttattaaggtaaactggttaattagatgccatacgagggtgtcacagtggggactagagggaacggaggacgggggcgttccctgagcgcctagcaggctgcgtttgtttggctttgaagccgttatccccttgtccgcaatgagaggtgctggtgtcaggcctgtgtgtctgtgatgtgacagagcgggactgagctctctccagatccgaggcgcggttgtcaggagaggtggcctgcaacggagagctgaggatgcagttcctgtgatgtggacttggagaattctctagtgagtctcctgtgctccaatttcaggaagatctgtcaattgttttttcttccagggaggtgtgtgtaatctcctaaaaggaactttcagctttaagtaactgtagcattttgaaatcctataagaaatgagatatctacatatattcattatttcatgtatgtggggtgtgtatgtgtgtgtgtaaaatatgggaaaggggtaagaaaggcttaaaaagtttaacttctaccagaaaagaaagcgaagagttaatttttttctccccaaatggtataacaatgcatatacaactaaatactcttgctgtgctgagatttctcataaggagtaagatttaggaattacaagtattcagagcactgtcatgttttcaaatcttgcaggcactgtcgaaatctggaaaaagggagtacgtacatagaaaacccatattaaaggaaaaaaacattgaaaatctcccaaaagaaaaccttatgacatttgaaaaggcctggatgttttctgatgccccagaaatctttctaatcctgtaattaaaaacagcacagaataagttgcatttaagaaatcagcaatcatgtttaaaagatatcttttgaccttctttttcgtacttttgatttttattatggaaattattgtgactgaaaatttgttgtttaatatatttgccttttaccacagataattagtcttccttatccttttaaaccactgttccagtttggaccaatttaattccccaaacatcaaattactgatgttccttctggaaaccatttatgtttaaaatggctaataagaatattatatttccaaaacaacataatttagtcagttgtaaaacttgcttgtaatttattctcatccattttgtttgaatggggcacatttgaagaagagcagcattttcttagaatatgccattttctgtgtgggaaaaagctagtgttttcatatatgttttagctattaaacagatgcatgtaaggtggcaatcctgtctgacctttgataaactgccagccagagggagagagatgctttcttagctgtgctagtgaattgataatctttactacaaaatggacacggttagatgcacataaggttgtgcagaaggaagttaaggagttttaaattaaataccagtttatgggtaggagacagatttttttttttaaccttgatcttcctgtttctttctttctgcagttcagcctgttgggctggcctttattggagagtcagaccagcactctgactagagagtgtttagcacattaaagtgctgtcttttgtagaaataatgatggctcttttgcaattaaaaggtaattttatacatgcttatagatttttgtgattgtttggtgaccaaattaagcataaccgttattatggtagaaagagttgttttatgaagttattgccactatatataaataattatatatttaagatatagatgaattctatttgaggtttaggagttttgaatcttaaggccagctgaccagatataaacctatttaattaactaatttgaatgacaccagaattcagatttttattaatatctacatctaggtttatgtagctttcctttctttttattagaattacttcttttttgaatttgtttaaatattacaacatattacattataatttgtacacactcagtggggaaggtgcaggttattcttaaatagagatgtggagaaatagctaacaaggagagtcatttgagaaacatatggacatcataaaatccttctgtatgtagcatctgtaccttctcattagtgaaatattgtagttatggacattttttgttattacatccaaatgtggctttttatttttgcttcattggtttttttttgtttgttttaaaatacaatttgtattactgtttaagttggtgggggctcttactgcttgaagccttttgctttcaatagacatcatacttaatttttattgcatgcatctgcagatatatacaattgtttcccagtttgttattataattcttacactttttggtgattcctcaaaacatttgagagataagtagggtgacatattgttctcattttaggaaggaggcggcaggtacactgatatacccaacgttacaccatagtgaatcagtgtgaagctgagcttaacatctatatttcctgtattttaattatgagagcaagctgctcctgtgtcttatgataacttcataaatttatgtatttctagatttttaaagtggtcatctttatacatgtgcagatcagattttaaatcagtcaatatagtcataaggggatggatcatactgttggcctgttgatgggagagaaccatgactctaatagctactgctgaaataaacaaagaagcacacacacctctgcagaatatttgttcttgcaatcaatccatagtccacatatttctctgccctgctggcctcaccctatcaactacctactgcccttttactgatcaaagcagttcttaaagtttatcagcacagttgtcaagcttgaggatcatcagcctcactggcaagaaaagtcagaacctgatttttgggaagagagagtattgacgggggacagtaatggagtgttcactccagaggcagccagtagtggtcagagatcatattctgggtgtcgggatgtctatttctctcatcagctctgcttctttggccgaacttacaggtatcaaagtgaacagaaggtttatggaattatctagtcatttctttccatgtagatctcatatctgaataaatcagactttttttaaaaaaaagaaaaggacagaaacttgttctttttcttcatctcaccaaatctcctctccttcaaatcccactagaatttttttaggataattgcccacatgatttgtaacactaaagtgatagacttctgatattgcattattacacttaacagtggaatatattatccagcttgcagaaggaagcattgtaattctgtagataatggtaatatgtaatcttatgcaagtatttttgaataagcagacagtaccaagagctctccattaagctaatatgtatattcttactcttccattccctaaattacaaatggtttataggagctcatccaaatcattaagtatcaagtactgaaaaaaagttcagatgtggtttcctgtttactatggtgaattttgtttagagcttcaaagagaggaaaactactatctattgtttgctgcaccagagagagtataacgtgtttctggtgagcttgaggagcattgaggttgctggaaatggtactttcttcacatctctacagaagctgtgataagaaggagatgggtgtggactggtttagttctagtacagtagtgatgactggaatttgaagtgaccactgaaagggtaagatttggatagtctgtgtgtcactcaaggtattcagtagcaagtcatggaaactaacttagttaatataagcatcaaataaatttattagaggatattgactttgttttctcttgctgtgtaacacatttccacaaatttagcagcttaacacaacacccctttatcatatcagtttcattgctcagaagtccacacatagctcaactaggtcctctggccagagatcttctcccatgttggctagggctgcaatcccaacagaagatcaataggaaaagatccactttcaagctcttttctattattggcagaatttatctcatagtggctgtaggactgaggcctccattttcttgctggctgtcattcagaggctgcccttaactcttagaggctgctgttattctttgccatgtggccctctcataggtactgttacaacatggcatcttacttttttaaagctagcaaggaagtctctcttgctccagtctgataagaaagagtcttatatactataatataatagtgagagagtgacatcaggctatacaagggcatgactccttggaggtcagcttagggtatgtccaccacattgactagctcatagaatctctggtgtagggtgggcacagtggcttatgccggtaatcccagcactttggcaggccaaggcagatgaactgcttgagtccaggagttcaagatcagcctgggcaacatggcgcgaccctgttgctacaaaaaaatgcagaaaaaattacctgaacgtgatggtgtgtgcctgaagtcccagctagttggcaggctgaggtgggaggatcacctgagtctgggaatttgaggctacagtaagccatgatcgtgccaccatgctccagcctgggcaacacagtaagaccctatttttctttctttctttttttttttttaaaaaaaagaacctctggtaaagtcagcagacctgactttgaagccactcaagtagaaacaaggctccaaatccctctgcagaatttgtcctgtgaggtactgctgctgtcgctgctggcatatagcttctacagttgaatgtgggctctatatcataaaagagaggattctccacatataataatggggtcccattgtccattgccaaaaagaatgacaggtgtccactgctgagggaaagaagaaaaaatgattgcttaatgaaatgtttgagtttttggccaggataggcatgatagccttctagggatgggattgaattggaaagtgactgaagtcatgatgacttcttggaagagaaaactcttccaggatttaggagaataatggtaatgagggtccatttatgagtggtagtgataagaaaggagtagaaaacctttgaaagatgaatcactacacatacattagtctgggtattgacttaattagtccctaaatatattccacgcatgaaagacttttaagggactgattccactaatccttgcagggaaccagcgctgtgacttggaggcctgcagtgtggtctaccctcattttatagaaaggagtagagctaaggaccattgtactatatttgtggcccagtgactatagggtgctatgtagtgggttggggactattgaacacaccctgtgctctaagcactttgccagacacattttatctattttgtatctcaaactctggcagtttagtttatatttccctagttctgcctcccttctcccctggcaggtgtgtggagactttgaaaggctaaatactttgccaagggtcgttcagctaggggtggcattaggatttgaatccaggtctgattccagagcctgaagtcttgtagtacacatcccatactcacaagcagtaagtgaagtttccagggggaaagcctgttactcacattgaagtggatgtcagtgctacaattgctgttgggttccatcattcagcttgagagaactggatactgcaagatgagggttaaagagaggagtgagagagtgtgctgtatcatgccttcttttattttctcagcaggaagtacatattataggtctctcttagatctaaaagtaagaatggggagtagaggctgtgcatttttatttctacttatcattttggttaaaatcaaaagcactgtgtctcctttctttcctatatgtagatttctactattaaattaaatcaggtaacattatgaattctcattgcctctttggccatagggttctttctatagctttttcagtagatgccactgttttgatcttgaaaagtctattgagacattcttcctttgttcttctattactcagtccctctttctactctgtggtgcctctgaaatctattcatagatattctacttttttcttctgttttatgtacttaaatatcttctttaaatggatctagttccattgatcagaatcattggcccagatccccttgctgctccactgtacccaggaagtcttatctattttctgttaattttactgagttttactctacatcccagcacagtatgaggaagcctttaagatttccctgggtatctgagcctaaatgtaaacatttaaaactgaatacctcaaggaagagtatgattggattgtgttagatcaggtgcacacctatggactactccactgtggccaggcaaagggagttttattattgctccatctgggttcaggtgtccacccttctagaatactactgttctcaaagaaggaaattgtgagccagccccagcttgactggggtcaacagtactaatctattctagagcacactgtagctcaggaagtctctaaataaacttaatttcttcatataggttttagatttcctaaactagattaggccagatttgactttaaaagcccaaacttcttagcatgacacaagttctttcacagcctggacccagcctatctttgttacctttacttttttttttttttttttaggtgcagggtcttgctctactcccaaggctggtgtgatcacagctcagtataaccttgagctcctaggctcaagtgatccttctgtgtcagcctcccaagtagctaggactcacaggctcatgccagcgtacctggctaattaaaaaaaattatttattgtttatttttaaacattttttgtggaaggggtcttgctgtattgcccagagtggtcttgtactcctggcctcaagctatcctcctgcttaggcctcccaaagcactaggattacaaatgtgagccaccgtgccaggcccttacatttttaactgttgcaactccctgcctttcatccagtaaatcattaaggatttcaatcctaaacttggagctagcaagtggcttcgattttagataaacaggaatagccagcctgagagaatacatcgacgtgtaaagaaaagtcaagatgagagagagagaaataagtacatttcagtttttcacttcctgcatccagtcattcttaagtctcgttctatagctgattttttccacggatatgttatgtgagcaatgaattatccataaattgagtttctgcctcttgcaatggaaagagaaccgtgtagcataggtttctataagtgatcatctcgtagcgaaaatcagactttcattctgctggggttctgttgggggattaggaagctgtgcttctctgccctactttttcactgggcccagtgtatgtcccacctcttctgtgatgcttcccctgattactacaacacactgagatctcattcctctctgaattcctactgtagtttagggttatggctatgttttcgcaggcttacaaatggaattctagtattaattgagaaaatccataataaaaaggctactgtattaggaaagtctttaaaaggaatttgcatttttattaccccaaacagcatccttatatttttgaaatatagtagtatatttaatatacaggaggatttacatgtgtatttatggtcttcttgcaattaccctgtggctcgctagagattcatagtctcccaccacttagatggaaaagagggcagagaaggtttggcttcctaatgggtaccttctccaaataaaacaccacaggaagaatgggccggttttgactaagactacaggtctgtacagtatgagtgtgtttattttttattaaacattctacttaggtatataggaacataaatatgaatgcttttgcttatagatttcataaattataaaaccaaacccaacaaacaaatgttgaatataaacaacagaattgatgaaattaaaagaaacaacattgaactctgtgacaaatgatgctgtattgttgaaattacattgccagtatccagtttaaaagtataaagatgcagtctcagattctgtttttctttaatctatttctatgttttatatcaatatagatacaaaaattgtccttttacaaccaaacaaacaatgttaactttgaggctttgtgtatggctcaggataatcaggctttacacatgatcaaaattcctcaaataatccctcaaatgtcaggtttaatgaggtatcacctgagatctctataacatcttttcgttcccttgaaaatgtgattagtattgtggagtcatcgaattctaaatcaaatctgtaagctgtattccaagatttctggaatggagaacagattatgtagaagctacacagagataggatgcatgcattatcttcacactcatgatgattataacctctatagtacaggtacttttgcctgcctgtgctacccagtgttctgtaatgactcacttcatcctcaccttttctctaaacagactttatttgtttagcaacctttctattctttggtctccacttagtttatgcatgattcaaaacaccaagtgcaaacaacatgatgaaaatttggtggcagtatttagtttttaaacgtttattcagaaactgattagcatacaacatgtatatttagatgatcatcccaatgaaatcccaaaatggaaaaaaaaatatttcacatcaagctcatggacctcagtttgaaatacacagttgcaaatgttaattggccacttaaaacattttacatcttgccttatgttgtgtgtcattaatgaaattgtaagctccttgaggtgagactatatgcttactgttttgttttcttccatagcactgtgtgcatttgttatagttggtgaccaaaaagtgtttgctgattgaccgattattaatatattgttatttcctattgctctgtgactcaaaggcagggactattttgttttaatctgtggtctctgaatgcgtagcacagcaactctcacatgagaagtgcctaataaatgttctgaatgaaagaatggatgacttgttggctttgtgtgtgtgtgtgtgtgtgtgtgtgtgtgtgtgtgtgtattcgtactcttttagatctaatctcttatgtacagggcacttctaacagttgtatagattagtgctgtccagtaagattttctgtgatgatggaaatattctatgtctatgctctgcaacatcatagccactaggcacatgtggtctttgaaatttagcaaatgtggccaatggcctgaattgagttttatttagttttaatgagtgcatagtcacacatggctagtgggcagcacagacccaaatgataaaatgtactttctcaaacttatttgctctcatatctaacattattatattttttggttataattggatgttgttatttgattttgttgtattggatggatgaagtgagtttatcactttaaaaatagggcaatatagtccaccaagttgacttcattctttcctaaatgaccagcaacattggatgtcatctgttcacttgccccaccatctattttggtatttcatcatttccttattaggctagaggcctgacaccgctttaccaaataagttttatgtacacttttacctttttttttttttttaatgacccaggttatcttgcgtttgcttgtctttctgttttagtccttttttcccctaataaaccatttaaacttggattatctatatcattattatcatttttagagacaaggtcttgctctgtcacacaggctataatgcagcagtgtgatcatagctcactgcagccttgaactcctgggctcagctgatcctcctgcctcagcttcccaaggagctgggactacaggcatataccaccacacctggctaattttttattagattttttcttttttagagatggaatcttgctttgttgaccaggctggtcttgaacttctggcctcaagtgatcctctggagtaactgagattataggagtggaccactgcacccagcctatattatcattgttaataccaccatcatcattttcatttctggtgtttatgctttgccagcccatatttgatgttgtgtactaacgtctactgatagtctaaacacatttcaaatttattataatctgaaaaatgtctgaatattctttttctccaattgttttctttgcttatcttgcccttttaccctttctggtccagaagaatgaactagcaccatatgcatttaaacattacaactcagtccttacataagatgtaatcccatcatgacaagtttcactgctgttgccaaatccgtgaaatcgatactacaggactgtcatttagaaagacaggaattgcttcctgcaaatggctgagatctttatgcaatttgtagttctgctggagcaagacttctaagttattgtacatatattgaacctcagtattgggtatattcaattctcctttaattcttataacagtattgaatctagtagtatgtaatggttatagaggctatctatgcaaataagttgaaatcagctctgctgactagcagaaatactttagaattttccactcattttctgtttactgctagagatttaattgttgtcttatgtggcagaatttgaatgcacagacttcagcatggaagcttgccttttgttcatttttttagtctagcttagtagttcccaaacttgagtgtgcatcagcatttctgttcagggcgatacacacaaaagattgttaactatactttatggatgagttaacctcttttcaaggcagttttgtctatactagattttcatcttggaacctacctttccctcattaccccaaagatgcatctcctctttattccttctatttctactttcagtccagcacacagctgctcattgagtggacttgtagatgtgctcttgaatagatttcacacaatgggagacaaattcagtagcaatatatagaattttgaacttgtgaatccccggttgagcttttatcttcttattgctttcatatgcctctctatggtgagaagctagtactgctttgttatcttctttcccaatttttccccataaacattctcctaaaaagccctaatgatgtaaatgatacattatgttcattcttgacaggttggggaaatgaggaagggaactttcctttgtgacttgtgctgtagatatattttaaaatctcctatttatctatttgacccaatttttaaaagttacctacattaaaataaatattaaataaatttagtattataatgaaacagtagtttgcttttatttataaagttcatctgggtgtgttggctcacgcctgtaatcccagcactttgggaggccgaggcaggtgtgtcacctgaggttgagagttcgacaccaacctggccaacatggtgaaatcctgtttctactaaaaatacaaaaaagaaaaaattagctgggtgcggtggtgggcacctgtaatcccagctacttgggaggctgaggcaggagaatcgtttggaccctggaggtggaggttgcagtgaactgagattgcatcactgcactccagcctgggcgacagagtgagactctgtctcaaaaaaataaagaaaaaaaaaataaagttcatcaaaggcctttgcttaaacttatgagataacttgtttactaaccagaacacccttttggagttacttactgcttttctctgtgagaacaaacatcatatattcaccttaacttatattttcaaaagtataatgctaagactactcaagccaagtgggaaagtgtaggccaaatggaatagtatttcagaataacggctacagttttaatttctctagaatagcagatctgaaatattgttgtgtgttctaattttcaggtaactactggaaactcattaaaatatattttataccctattctatttttcttacatatgttataaagcccttactacattcgtattttattaaaacagtaattatttaaagatatttatgtaaaacagaaatcttttgtatttactcgagtagttaccatttcagtgctctttattcctttgtctatatccagattttcctctgatatcctcttccttctgcctgacttcctttaaacattccttgtggcacagatctgctggtgatgaatcctatcagcttgcttttgtatttctgaaaatgtcttatttcaccttatttttgttggatatagaattctaggtcagtttttttcttttaatagtttaaagatgttacttcactgttttatcatttgcatttttttttacaagaaacctgctgtcattcttacttttgttctcctttatagatatcaagtcctataacgtattctgtttattcctggttttgaacaatttgattttaatgtatcttggtatagctttcttcatgtttcttgtgctttgggttcattgagcttcttgggcctgagggttaatagtttccatcaaatttgaaaaaaaagttagtcattatttcttcagaatttttttaggagtccctcctcttttttctcttattcaggaactccagttgcatgtatattaggatcactgatgctctgtttgtttatttttattttttcttctccatatgttacattttgagtagtttctattgctgtgtcttcaagttcattaccaagtagtcatatttagtgtgttctccatctcacacattgtagttttcatctcttgaagttcaatggggtgtttcacaattttccatgtccctatttaactttctggacatatggaatagattcataataactgttttaatgaccttgtttgcaaattctaatgtcttttttagttcttggtcaattttgtttgatagactttttatccttgctattggttatattttcctatatctttgcatgcctagtaatttttgatggatgccagacatcgtgaattgtagggtgctggatatttttatattcctataaatcttcttgagtattttttttctgggatgcaattagttactgggaaacagcttgatcctttcaggtcttgtttttaagattagtttctgagtactctacccaacaccccatgaattatgaagttttccagtctggctggtaggaataggcacaattcccagacttgtgtgagtgctgggtactgttcccattaacactttcaggtggttcttttcctaactttgggttgttttctcacatctgtgtcctgatcattacactgctgaatattcaaggggggagctcatttgtagacctctgaatatctcttcatatttagctttcccccctccagtactctggcctgtgacatccagctgctctgatctccttagttcctccaattcatctcctcaattcagggattattctaggctctgcctgggttttcctttcctgggccacaatctggaagctggactagtcatagagcccaggtcatcagtttcccatttcttagggttcacctcgtgtgttttctgtttgtcaaggattattgcattgtgtccagtgtcttgaaaactattgcttcatattttgtacagaacttttattttcttaggcagggggataattccaatccctcttactcagtcttctttggaagtggttcccccattccttttctcttccatgtaaaaccttgttggtcaatatcattttggcgactacttaagtatttaatgctcaatttaatgtagtttattttgatattctacatctttcttttcagcagtttccaaattttctttaattaacattttatattacaagcatattttaaaaaatccattttgcacagttatattctatatcatgcttgatgcttttatcactgtcctagccattcaaaaccattcttaaggcaagctggtcataaaataaggagttaaatttgttgagcataataatttacatgcttttaagtggataaaagatgccactatgggaaagtaccatgttttttaaggatagaagccaagtggctttgaaataatgtactcttgaatctagtaaatgtgaatgatcataaaacagctcataaattactatattttaaattggatcacttatggattgctcctcttttatatttattcaggaggttctgtagttcatggataggccttgagattgttcatatgtcaagcaatagtgaactatgtgctggtgaattattttatttttaatcctctctcatatttgaatgataaaatatactactgtgaactaatatgagaataaagtgtcaaaattcaggagcacatcttgctatagtgaatacatcttgttacttcaagagttttctggcagtaagggcacaattgactgtgataatttaaaagaatccttgaggtggtatagttccatatgtcgtaggaatatgtcaatgattttttaattttgcaatttgagtttttaatgtagtcttttgaaagctagttgttaagcatggcaagaagactagagttactttagaattcttaggaaaataattttgtaagaacaaattaaaattaactttttcttcagcactgtcataaatatcagcaccatgaagccaaaattgtggcagtgttacatggctatgtttccaatatttaagaataaaggttaggccagatttatattctcttgcaaaattgaaccaaaatataaataatttatagaattttaagaatagaatcttgaaaaagcgaatactactctgtgagggagactgttagttgtctcctagtctctcttttccccactgtcctcagacataaagcacctaagttttagctggggacaaatccctacaggatagagatgacatttcttagccttccttgcagctaagaattttaaaccatgtgacaaagttctgaccacaggatataaacagaatggttatgtgcaacttccaagtaggccattaaaggacggggtgtgctgtctcctttcccttctcatttgctggaatgtgggaataatggttgcctatcttagactttgctaaggatgccagcactttaagaatggcagagcaacaagatttttaaagaaggcctaggacagtgtattaatctgttctcacactgctaataaagacatacccgagactgggtaatttataaaggaatgaggtttaagggactcacagttccacattgcgggggaggcctcacaatcatggtggaaggcaaaggagcaaaggcacatcttacatagtggcaggcaagagagcttgtgcaggggaactcctatttataaaaccatcagatctcatgagacttgttcactaccatgggaacagtatgggggaaaccaaccacatgattcaattatctccacctggctccatccttaacacatggggattattacaattcagggtgagatttggttggggacacagccaaaccatatcagactgtgatagtgacatttttactttattattttattttattttatattcgggggatacatatgcaagtttgttacaagggtatattgtgtgatgctgaggtttgggcatctgtcgatcccatcactcaaatagtgaacatagtacccaataggaggtttttcagccctttgcgccatctctctggctcctcccttttggagtccccggtgcctattgttcatagatgatgacttcttgaagcagagttgccataacagcttggagtcttgtctaactaagccactgttattttcagtctctgtcacgtacagccaaagctatatgcagtaagtcctcacttatcgttatggataggttcttggaatctgcgaccttaagtgaaatgacgtacaaggaaaccactgttaccacaggctaattgatataaacaagagttaagctcctatggcatatttctggtcacaaaaatatcaccaaacttctacataaagatcgaaatatttctaatataaaacatcggaataaatgtgagctatacatacataagaaagattcctaaaaacaagtctgaaaattgtttacccacttacaccaattcatggtcttgggtggccagagccgatcccagcagttcagggcaccagttgggaaccagccccggacaggatgccatcccatctcagggaacactcatacccacccacattcagaccgagactgtgtagacacgctgattcacctaacatgcacagctttgggatgtgggaggaaaccggagtacccagagaaaacccgtgcagacaaggggagcatgtgcaaactctatgcacacagtggcccgggctaggaagtcattttttcttttatcaactttataatgaaacaaatgaaatgacattatttgagaacctgctgtacattgttcccataattgtatttttttttttgtttataagacacattaagggtttctttttgtaaccataagcttgaaaggaccaagtgatcatacatcatagagatctaaactttttcaaaggccttcatttttttaaaaccagactatttcaatatctatcagctgaggtgaggaacacaatataattaaacttacctggctcttgtctgagaaatttaaaaaaagatttgaggcacttaaatccttatgctgacttttgaaaaaaacaagggttgggaaaagagagaatgctaagttgttcagctttctactttgcccgcagacaccaaatattttttcaattttcagttcccagtgtgaaaagactccctataccatttcacactgtttactactcccccttttggaaatgatcatcccagagcttctgggatatcatactctccagtttcctcctctgcctctgctctctccttgtctcctttttgggaccctatttaattcactccctcagtgtgggcatattctgattcttggctcacttttccctttactctgtaagggagatcacaaattggcagcttatagacatgttttgttgatgccacacagaattcaaagtaatttaaattttgaattaatcttttctaaaggctatttccttttcctccccctttgttttcaattccatttcctccttcagatcatttctactattatcttaatcagacaatcatgttgtcttacctggcttccttgcaatagaattctaaccaatattacttttggaatagcctttctaaaatgaaattttaatatttttctatctagcctcaaaactttgatcagctcatctgctttctagatgagatttcatctacatctagatgctttctagatggggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctagatgctttctagatgtagatttcaaactctggtgttggtatgaatgcaaaatgggcacagccacttcagaaaacaattttggtagttcctcaaaaagctaaccagagagttactatattagctaggtatacacccaaaagaattgaaaacatatttccagacaaaaatgtatatatgattattcatgtccatttataatagccagaaagtggaaacaacccaaatgtttaccacctggtgaatagataaacaaaatgtggtgtagttgcacaatggcatattactaggtaatcaaaaaggaatgaagcagtgatttatgctacacctgggtgaaccttgaaaacattatgctaagtgaaagaagccagacttacaaggccacatgctattttattcaatttataggaaatagccaaagactaaaggtagaatagtggttgcctgaggcaaagggaagggggaatgagatgtgactgctaaaggatatagggtttctttctgtggcaatgaaaattttctggaattagatggggctgatggctgtatacctctgtgaatataataaaaatcactgaattatatagattaaaagggtaaatttttaggtatgtgaatgatacctcagaaaaagtcagggaacgcagtgaaaaacaaaacaaaaaccgaaagctccttagaactcaagatccttcatgatctgacctttgctggttttcccagtctcatttctgggtactttgtctttccatatccattgcctgtctgttcctctctcccttgcactagtctgctaatctacaaactcttccaagagttccatgctgtctatgagtcttattatccatgcacacatttctttttttttttgagatggagtcccactctgtctcccaggctggagtgcagtggtgcgatcttagctcactgcaacctccgcctcccaggttcaagtgattctcctgcctcagcctcctgagtagctgagattacaggcacactctacgacacctggctaattttttatatttttggtaaagatggggtttcaccatgttagccaggctggtcttgaactcctaacctcaaatgatctgcctgctgcagcctcccagtgtgctgggattacaggcgtgagccaccgtggctggccctgtgtacacatttctaccagaaaagtccttcccactctcttctcctcacattcatctcttaaattcctgattttcttttgagttcatatttcacctctcctggaatccctttttatacaccagtgctggaatacttaatagggggattatgtagactcttcagggcaggcaggagtaccctacaaatgaaaataaattaactttgatgagcttataccacctttgcaatcagaaaatcttgaaagaagcttttttgagtgtgcatgtaagtgttatgtttcatagtttttaaactttaaataaaatgtagtggactgggtatgcaactatgatattttagaacaagcatcatgtcacaatattaatctggctttgctgccccctctcccctgccctgtgtagattaggagcaaacctagggtgtttgcgcttcccaaatactctgggcatcccttgctaccctaaatggtaaatatccgtttctttttctgtctctccatctagactgggagctgcttagtgataactgctttgtctttcattaaaaaaatctttacaactaaattccagtaattctccatagaaagtgtttggtaagttttgaacaaatgattagacatcctttgtggtcaaatgtaggcatgtgagagagactactagcatttgccctactgaagatcagagatctgaggacattttaagaaatgcctaattagatggcttcattgaaatacaacttgatctctttcttgctctctctctctctctctcacacgcacacacacacacagacagacacctcctttaaaaagctaattcaaaaagagtagaagcaaaaaagtgagatttaaaactttttctcaacctatacacctgaggaaggtgttagatttaaggcctaaagtggattttaaactgacacctcccctaacatatttttaaagtgttttctgtactttttaaaacagcttttctttttcatgtcagcaaattcatgagttaacattcatgtactaacattaactcccattttggacttgctcattatgcagtggtagatagtggctggttaatgttttctctttcaaaaatgtgattatacttagttatttataagtaattcccccttttttacctttcatttttaaaactagaaattcttgtttcgaccctatatgtcttatttgggttctctgaatcagattcttagacaaagatttgagtgcaggtagtttactaaggaggcattcagtaaactgtttgtattaagcaagttactgacttgagcaactgaaattttaattctttcgggggacctgtgaaaaatatgcctacaattagctacatgagaagcaagggagttgggatatgatatcctagaacctgttagtccttagttgagggctcttctagggggtgttaatacccagagtttccaactgcagtgcaggtccagagaaaaccctcaggtaaagaaataaaagggttgacggttggaagtctgtgggcacagattcaagtagcaatgaccagggagtgtggggcagtaccaacagcgttcactgtatatggagatgggcgccatcatgggaggagtgctcaagtgtgaaaaagcccagaatttaagttagtttttctcaagcatttactcagtcctcaggtaagtacctactgtgtgtaaaggctgtactaggtaatgggatgtatgaattcgcttgtagaggcaattagctgtttaaagctcagtttctttatttcaaatgagaacttattttctttctttcaaaatggagaatcaaatgagatcgtattcctgaacatactttaaaatgttgagagcattttacactcatctcctttttttttttttttttttttggatatggagtctcactcttgcccaggctggagtggcagtgttgtgattttggcacactgtaacctctgcctcctgcctcccagattcaagcgattctcctgcctcagcttcctgagtagctaggattacaggcgcgtgccaccacacccagctaatttttgtatttttagtagagacagagtttcaccatgttggtcaggttggtctcgaactcctgacctcatgatcctccctcctcggcctcccaaagtgttggattacaggtgtgagccactgcgcctggccacactcgtctcttatcaggaatatgttagccagtcaaaagcttgttttcttcttaggccatgtgaatttggcctctctgcgaaacatgtataagacagtaaatttaaaagtttcatgaaaggaataaggtaccatggggatggttatttttagccagttggcagtgaagacttcctggggaaagtggataaaatggaccttaaagtaatggataggaattatccatgtggaaacagggaatttctgaaggaacagtgaattccaggagagcttgagcaaagccctagaggcagtgcaactgagaaccactcagtacccaggttaagcattttttcccccttaactacaaattgaggatattagtactacctacactataagattgttgtaaggatatcttgtaaggataaatgagctatgtcatgtaaggtaggtaggttagggtaaattctaacttcatctgtagcttttggtgtcagtgtagtttctgatgataagttatccagtcccaaagaaagcagtgtttcctaaagtagatgggatgtaaaccccacaacatctgcaagaaaaaaggattatgacattaaaagaatttgagaaatcctgtgtaccatacatagatggatttcatagagaggcacattaagatattaacagtgctgagaagtgcagcaataaataaacctttttttttttactttgtttaatgctgtgtattaaatttctttaattgctggtttcttttctccccttaatgtaatacttattcatgttggacattctttgtaaaatgtgaatttgaagagcttcatgtggtgcgccaaccaagttaccagtacttacatatccactttaatgttgttaatctatcttaaggagttgtaaatggcttgaaataataagaaactttgcttaaaatactttttgtgattctccctctaggcatgcttctgagcagtttcttagtcattgcccccacatcaatcattgtatggtgctttacatatttcattcctcattttctgcacagaattgtattgctcaccccatgatttctcccaggcctcagatctgctcagaatgatgtttttttggcctcacttgagataatttaaagaacattccccagacaattctgaaagttgacttccaaaaatacttggagtaatgccatcatcattaaactaagtggatgactttcaaggtgagtggttttaaaagggacagcagcttcttggacgtgcactttctctgcagaacaaatggtttgtctttttatagtcatagaaggagctctgaattcctactatgtgtttgtccttttggtagatatagtctattttgggcagaagttcatagtctactggggtaaaaaataaatgttcaaaagtaaccactgtagaagaggatagatatagtcataaaagctacagagtgttatcaaagtacagaggaggggtcttccataggggtcaagaaaagtggcaaggatacttacgatgaaccttgaataccacatgaacaatagagatattccaggcagagagaagtaatgtgcagaggcccagagatgtgacaaaggacaaggaactccatgtaagtgcaaatggagtgtagactccacatgggaatatggatggtgagtgaggctgggaagccagatggagtcctgactataaagggctgtgtaagtgctggggtaaagagtttggagtttagcctctagatggtagagcacacctgatagattattagacagagatggccatagtcacaattttaagcaatttggtaagtggcaactatgcagttgagttggagtgaggaaagacgggggccaggagcttgggaggctattacagcggtccagccaacggggagtctaaactgaggtagtaattgtgatgatggggaagacaaaatggatatgatagatatttaaaagatgaggaacggagatgataaggggagtctgggattctttcacatggggaagagtttggatgttggtataggtcagtgtaattagaattcaggagagaaacacattttaagggacatttgctgagttgtattctgtatttgttgtgtttgaagtgcttatgggttattcatttgtattttcatcagttcctagagtaagtactctgtgccaaacaatgtgtttgactctgaggatgtggcaagaaaagagtcagaatgttccatgtgcctgtgaagcttacagcttagtgggagagacagacgtaaataattacccaactaattacttcattagtaagtatagaagaaggggacctaactcataaggaagtcttctgtccattctggaacttagcaaaatagtttggtctgcaaagtgacagagatttgaggatgattggtgagtagttgctaactgaagtcattagtgagattgcccagactaggtttgcaaaacaggcagaaaaggaggcctaggttagaatgtgaatatttaaggagaaagttagataaagtcctaaaatgaagctggaaaagagtggcagagtatcactgcccctcggtatctgtggtggattggttccagcgactcccttggataccaatatcagtggatgcccaagtctcttgggtaaaagggtatagtgtttgcatataatccatactgtatactttaaatcgtctctatattactaataatacctaattcagtataaatgctatgtaagtagttggtatactgtattgtttttcaacttgtatttttatattgttattgcttatttatttatttttaaaaaatattttgcatttgcaattgaatttggggatgtggaatccatagatacggagggccaattgtaatttaaaggtgtatggaaagggttgggaatgttgccaagaggtcacataaagtaaatgtaagaggtgccatgggctttgaaactgcagttccatgctggctctagcaagagcaggtgcagtagagtggtgtatgtacaagctgtatttcctgccagtggtgtgctagatctagcttatgctgccttgagagagctggattgttaaattttcaggaattatgcaagctggttgttaaaatagccattagtaaaaattaaagtatgtacacttacaattaaattgtattagaatagatgtagtaaaaatattaaagctcatcctccctaattattttacaacatttttctattatctatgctcttaaggttatttatgtctattattttcctgaatgggtggatgtactatacaatggtgtactaccgcacatttcttttcaagtctatgtttattgactcttgttggcatattgaaattagccaaagtgagagtatttacaccgtggaaattggcaaataaatgccacaaatcggagattttgttttgttgattttctagacctgagaaagtgatagagaaattgttaagaatgcggactacagttaaacttgtgttggtatacaacaattacattgtgaatggcacaaaaaaatcgaggaaatggtctttcggtacttgtgaactgtcatccaattcaataaagaagttgctctcaatattgatgagtaagagaagttccgatatacacagtcattgtttcactttcttcttacttattaatgcaaaagaaaatattattagtgtcagaacctaccaggtttggtaagtattaatgaaagcattttgtaagaaacagttggctatatggaattttcagtaaaggatattatatgttttattattatttgtcaattgtgtgctgtatctcctttattttagtacaatttataatgaacatatatatgtgtgtatatacacttttattttgatgagagccagttgttaacatttatcagcacacagtggctatatatatgggatgtgaagaagcaggtcacacgtacttttttgaaaagtatggcagagaagggatgttgcataggtactaggttggtaggtagtcagaagatgtttacaggtttgggagagcgtttgtttgtttgtgtttttccttgagtggaaagtgagcagccagtagagagggagagattgatggtacaggcgaaggtggaagtaaatgttagaagaaggcgataaagaaataggaagaaataagatatagactattgtgggaaaattaaccttgaacacaggaaggacccctattcctgtaaggatgaggaaatgataaacataagatgtgataaattaagtacacgtacattaaaatcacgtacatcagtgaattgtaatttaagaaataagaaggatgaggtcaggaaaagaagctcagaaagatatcagttaatttatgaataaagtatagattaagaggtgaatactatgattgaccatggcaagatttcatgctgatttaatctctgaactattatgctgtatttttagtctgtttttctaggctgaaatatttaaataaaaaatgagagacaatttgaaggcgcctcattgcatttaaatgccaactattatttcttttacttagctttgcaatgtaatgctacatttccatggacacggattaagtttctacgagatgatcagaaatgggatataatttgaggttgactaaactacattcattgcatgcatggatagtttgaacacaaggtaaaatgttatccagactgctgaagaaaacaagtcttattttggaacatgactttcttcagcattataatttatgactttttcacttggattcttgcttttaacacactcttatttgtatatgtatgcttcaattaaagaaatgcataacattttgcttacactgtcttagttctattagttttcctgtattaaaatttgcagtccttatatttctctcagttgaaacatagtaagatacagagcttttttttatatttgcatggtagtttgacatttcaaatcttttcagatctattttctgaaatattaattatcctaaatattcatagagattggtattgatgatgctaaatatggctgttgatattgaatatacatatgtaatctgcccttagtgtgccattgtagctatcactttgagcctaacactgtagttacattccccctcaccttgcagtctaacagcacctcagacatctggctgaggacctcaagactttggaaaaataactctgcatgtatgttttcagagttataacactgttgtagcccactcagacagctggtccttgtgtttgttgattaatttatggttgcaagatgatactgtggtctaaatatcatgttcaaggtagaaaaagagggaagaatcagcacagcactagccatgtgtgtgtctggtttaatcaaggaagcaaacgcattagagagacatccttagcggaattcttcttagacctcattggccacccttggctacaatagagtttgggaatgtgaatatttagctttcccacatctatattgggagacagcaaaggagaaattggtagagaatgactgttgttagccaattagtagtgtttgccaaaggggatgatctcaagtcctgtctagctccaacctttgcatttttactatcagttgaatgctatttcacctggaaggctacctttttagtccttacctgcaggcctgggacaaactttgttgacctccatctagactatttttaattaataagtgaagacctgacacaattccttctggcggagaggatccattcttcaatgtcaatctagatggagcagtccaggaagtaaccccagacttgaaagggaaccaatattaatgacatctcattctcaagcatggctgctgggaaggcttctgtaaaaaagataagcaaagaggaaagtgatctgagaatctgcctgataatactttttatatctgaacgatttaaacaaatatagctgcatacattgctgggtggttttccgttttgtgtgggactatatattcagacttcttgtttgaaatatgttagcctcttcgcagctaaaaaatattagaaacgagtgaaatttaaggcaaccatttgttcatacactcccagggagcatagagtatagattagaagtgtataagtatatttctaaaaaattcatatgtccgggcacagtggctcatgcctgtaatcccagcactttgagaggccaacgtgggaggatcacaaggtcaggagatcgagaccatcgtggctaacacggtgaaaccccatctctactaaaaatgcaaaaaaaattagctgggcttggtggcgggcgcctgtagtcccagctacttgggaggctgaggcaggagaatggcatgaacccgggaggcagagcttgcagtgagcagagattgtgccactgcactccagcctaggtgacagagcgagactctgtctcaaaaaaaaaaaaaaaatccatatatggatcaatcttgcagtattcacatttgcaaaaatataatacttctgatcttctaggcaagtgataattcttttagatttgtgagaatatttttagatgacaaaaaaattggttgcacaagtgcatgaaaagccaatgattatgttatttgcaaaattacattccaccatgaaaatacaatgagatataagtttttctgaaaatgtagtagattccagtattgggttaagtcatttacattttatattattttatatccttgagggagttactattattttctccttttgaggaatttgatgttcaaatcggttatttgaccagtgtttcagtgccagtaactcatagcagctatactgtgaaaccaggcagtttgccatacctgccagctgtggacctgtgctcctagtaataataacaattaggcattatgccaaagattttatagtcacttaatctattattcattaaaatcctagaagctgatactactatcatcatccctgttttaaagctgagaataaatagtattagagagattcagtagctgtctcaattttttgcagcttccagggctaacctgtggcttcaaactcaggtatctgacaccatgtggaccctaaccacttcactacattgatacttagttacacgttgaattgtatctctatagttttctataaaatgtagtgtttatttctatagagaaaaattcatccacgttttgaaattcaagaaaagccttctcatgtttctcaatggtttcatgctgagataattttcctgtgttagatcaaatttgctagcaattttcgtggtgtatgttaatgaaaatttgatatgcattgctttgtttcttgcatatataaccataatttagattagttcattttttaggtaattgaatttttgagaataagaaataaatttatattagaaaaattccagaatgagaaattggacacaaattctagcaattgtgaaaattatgcctgcttggaaaagttacattttatgttacttgctaaaattttttgaaaaggataaagtgatcaatttatctgtcaactatcactttgattaaatgatattaatcaaaagtactgtgtattcccttatactgtgaattatgattgggaaaaatgtgattgatattcagtgtttaaaaataacctacctctttatagaaacagctatatgaaattatagttcattctagatcaatagtgctttggttttggttaacatatgtatcacataaaatatatatgttttggttaacatacgtatcaaataacatatgtatcaaataaaataataaaaatttatttttttattaacaaataatagagttgatttaataaatcaactctattattctaggcagatttcatagcctaactccccttcaccaaattcagtgctgtatttcatagtgattgactcagaggagaaagatctgtgacttctatcttgctgcatgaccttggggaaaattggcttaaatgtatgaaaggatatttcaggcattgactcagactaaataaatgtgctaaatttgatacagtgagtgggaaatttttctcaccacatggaaccactaatgagcttgggaagtaaacatagttaagtaggcatagttgcctttttgttacaatcattctgaattggtccattagcctgaataacatttcaatgaacttcacatttgtagctttaggattgaccaaaccaaaccgcaacattataaactatttccaggtgagagggttgtagtgggttgaattgtttttccccaagaggtctgtttaaatctgaacccctggtaccagtgaatgcgaccttatttggaaaaaaggtctttgccgatgtaatgaagttaagatgagatcatactggagtagggtggcctatcaatccaatatgactggtatccttataaaaaagaagagaaggtcaggagatcgagaccttcctggctaacacggtgaaaccccatctctacaaaaaatacaaaaaattagccaggcgtggtggtgggcgcctgtagtcccagctactcgggaggctgaggcaggagaatcgcgtgaacctgggaggcggagcttgcagtgagccgagatcgcgccactgcactccagcctgggcaacagagcgagactctgtctcaaaaaataaaataaaaaattaaaaaaaaaaaaaagagaagagatagagagactgagatccccgcagggaaaacaccatgtgacatcagaggtggagactgggatgatgcagcattgaattgatgcattgggatgatgcacccactgaagaatgctaaggattgcctgccaccagcagaagctaggaagaggcaaggaaggactccatccagagtctgagagggagcgtggacctgctgacaccttgatttcagacttctggccttgagaactgtgagaaaataaacatctgtggttttaagctgcccagtctgtggtactttgttacggcagccctaggaaaggaattcagaagttgagaatggagagacaatggagagaatgaagagtcagcagcagtggtagtgctccctggattgactctttctcctgtagttccacatctttcctcctctcttatgttattatcatacacattagacaactgggctctgtttcctcccccttcatcacttacagatctctctgagtctcatttgccttgtcagtgtgatgaggatcttaaactcctctgagtaataataacaaccaacatttatgggagtttaaccccatagtaaagccagggctcagggttaacatgcattctttcatttactcctcaccagaatccatgaggattatattgttattatccctacttcacaaatgagccaagtaatcacatttctctatgacatcttgctttctcttgccttgttccttcagagacttgaacatgagagtcagaactggaatattgtcagtccttatggttccttgatgggaaatatagcagatccctaactttacttaatctgggtagaatgggggtgaaggccattggaaaggaatgttacatcaacatgttgtgtttgtcttggccatgtcacagtttcttcatgtatagaacatagaaattttttataaaaattctttcttcattatatttcccctattttattggggaaaataattttaatataactcccttattttctagcttgcttgacaatttcactgtctgagctacttaggatataacagaggaatttaatgatatagttgctattattgacattcaccatgtgctaggaacagcattatgtacagcagactatcagatgggtgatattattactccacaccctacagtccagggcttaagaaagtaacatggtccaaattactagccttcaaatccttgtctattttgtatccagagcctatttttgtatattctttttagggaaagccattactacagtgacatggattaatttatcagattaatgctgaacttggaagctggacatctgggctttaagagaatattggccaagaaagggtagtatgggaaatcggaaaacacctgaaaagtggcatgctgaatgcaggtagcttagatttaagacggcatgagtaccccatttttgtcagcatggggatatcagagttgaacctggcttctttcagaatattttatctgaagctcttctagagttagactaatttccttaattaccataattagggccaagcaaaaattggatgtttcctgtttcactttttggttgcttattttctctgagtcaagaacatgataacaaactttacactctatttctaacatggaccttttagtaaatggtaggttactataacagaaaagatgctatatctgaaatcaaagtgcaccagtccattgcatgctccatgctatttccttgcaagtctagatactgtcacatgcctgtaatactaaatagtcttagaaaatacagcaagcagcagtgttggaataggtcttagaggcaaaactgatctgaccaagcaatgtatgttggttaagtgaaatatgaaaggcagtctgttctatctcagctgaggacatttgccatagaaaatgtttgttatggcacagtagagagaccgaagctaccagtttcttaccaccaaacttgtcttggttgaatttgtctcctgtcttctaaactctagagaactgtcggtcttctgaagaactgttcagcgtagtgaaggaaacaggaagagagattgaggagcttagccagttgatcagagggatttaatgggaaaacacacttggatagtgaatagacactggaaaatctgactgtctaatttggattttcccaatatacctgtcatggtaaagtgaaatatctgttggactgaaagtaagtgtgtcagttattttggtcacagctctgctacaaattgacattatgactgggaagtggtggtttgtgcccataactttctccgtgagtcaaagctgtgggattttacatcctttcaacttctctcaaaattcttttctacttaaaagaccataggtgtcatattgagaattcatttcatcaagtattgatcaatccttggggtgtttgccatgatcttgtcatgctttccatctttgccaccaaagaatgtttttgggggtaatgtatgggaagtttgaaatgtgaattatatcacagtttgtatctggaaatcagtgtctaatagataatgatgatagtgactactgtctagtaaacatttactactgggtagaaaagtcaccagattctccacaggagaagattttgctcccttgggacatttggcaatgtctggagacatcacaacagaagggaggagtgctactggcatctagtgggcagaggccaggggtgctgctcaatatcttacattgcacaggacagccccccacaacaaagaattatgtggtccacaaggccagtagtagtaaggttgagaaatcctgctttacagcttgtttaataaatatgcatgctgatcatagaggatgttatgctcatcttgtagctgaggttcaaaagggttaagtaaattcttcaatgtcaagccattcattagagacggagccagcattccattccagtctgtaaagccaattgagggatggtccccaaacacaaaccttttctattttgctgctttgggaagttttcttcatcctcgtttcttcatttttaagataagaagatctgtcctttaccagaagtttgtagtagtatatttgggtgggggtaggcagcggggagaaaagacagggggtttggagattttcaaaaagttgaggtattatgcttaaatgtaatatttttggcaaaaatctgtagtcataagcagtgtgggtgaaatacaaagtgtatatttagactttagtgttgctcatacatatgcattgtttttagattaagaatgagagcttttagtttttgcttctctttgtatctttcaaaagcaatttgatttgctcttctcttgggcatgatggtgatttgtagagcttgctggttgttgagaaatcgaagactctttgtgggttcttaaggatgagagtttacttccacactggcagtaaggtagatgttgggttttggacttagagcataacagaagacatagagatgagagaatggccaaattgcattttagagaaagaagtgcggagaaccccatgagaaaactgtgttttacttacatctctggtcactgataaatctcaattttgggacaaatcctgacagataaggaaggttattggaatgtaagaggtaagaaaaagttaatttaaattattttatttgaaaacttacattttatgagtgggaagtgtggtttaaggtaattggcaagactccctcctctagaatattaaatttttgtcaaaactgccttttgaatagagtattttgggacttgcacattgaaaaatataggcagttgccttgtgtagggctatacttgcccgtagagttttacacttccacagggtgtcgggttttgttctggagacttgtggcagcagctttagctgctttgtgtgataatcagcacacagagcaaaggcacctcagtaatttactgggtgttcattctgtcaattggtaggtttaataaagagagaaaggacaggacatgtagctaatacagccaaggtaaggtgagcaccataagaatatgcaaaaaaaaaaaaaaaccattgaaattatctataaaggagttgaaaaaacagcttttaatcaacattcaataattgaaccttttaagggagcagtacacagagatgtgctcagtgtggcagtcaagttaaccgaaagaatgaattccagcttttcaacgtgaatttcaaagcatcaggaacactgaggcctaaaccttactgtcttatactaacaagagtcttactgttttataataactacattctttttacaggcattactaatgattgcaatttatttttagataaaaaaggttattattgagagtaggattagacactctgaaactcttaacagtttacaaagaagagatgaagagatcttgaggaaaagatgaacttttctatgtcatatccaaccttgatttgaatcggaattattattttgtgtttctttttcaaccttttatgaaatgaaggcattcttgtatttcttcaacatgccagttccccagaaaccaacttcaagatccatggtatcagcagaatttaagtacaagtaacagtaattatagtattgaaaagcccccatagcattcaatcataatattttatttaaggttgggagagcttaagttaattcattttcacaagcagttgaaagattgtggtggaattgactttctttagagaccatatgcatatttaccagttgaataaactctggttgtcagttatgtgtgtaggttggtgagaatatggatatgttatatgagggcagtattcttgtagcgggagaagaagatgtaaagtaatggaactgacagtgagtgcctactgggtttcagacacagcgctgggaaatgctttggtatgtagttgtcacaatgtctctgggacctagatgatattattttcattttatagctgaagaaaaaagccaaaataactaggaagtatttttcctactatatccttatctgagtcaagaaatggatattttttttgatgtatatgtttagtgggggcaacttttagttgttggttgactcgaacacagaattctaaggatttgggtctatcattatttttaatttttgtggtgttgtttttgagacagagtcttgctgtgtcccccaggctggaatgcaacagcatgatctcagctcactgcaacctccacctcccaagttcaagcgattctcctgcctcagcctcctgagtagctgggattacaggtgtgtgccaccataccgagctaatttttatatctttagttgagatggggtttcaccatgttggccagtctggccttgaactcctggcctcaagtgatcttcctgcctcagcctcccaaagtgctcaggcatgagccacagtgcccagcctggatctatcattacatacaaagatttctgctagggtttttttctttatttgagggcaaataattcatatacttattcaaattactgctttaaatatttcccaatggccctaaagagacattggttgcagtgacaggttttggcacaatgggtggttatttcctaataaatagcccaatacctatttaatttgtaaagtaattccttcctccaacagaaaattactttaaaatggaagctggtaggctatcttagttctaattttgcattgcaagttggtactgcaagaggtcacaacccccttttattcagagctattttatctaaaatggtaaaggaacatttatcagtttaaaagccagaactccaaatgtgatttttgcagctgataactcagtttcatgcctaagtattttaattataaacaaatatgtaaccccccgatttaaaacaggtggcattcaaaagttcatttggaacagagtcgtatgaaatttgaaacatttttccatagaaacaatgttaggtttccaggccaacccacaaaagcctatttaaaccatatcgtacaatttctgctctaaaatcatcacggggcccacacaacatatataataatatttctattgggaaaatgcatttggagtttagcttggaatagactagaatttcactggagtagaactgggcattttaaagtcctcctgccattttggcaatgaggatcagcattttttccctaagatgtatctttggttcccatgacctggggtgaagcagtatgaaggctagggcaggcaacagggtgtcttccaagggtgaattcatgattcaacatgcttttggctacaagcaagagactattgaacttgaatactagagttaattctctcacataataagtctaaaacaggcagtttaagcagtggttaatttaacatctcatttaagtcagggttctataaacctttataaccttatagttggaagatgtccaccaaatatgtaagaatcttgtctgtacataacaacctcctaaaggagaaagaatgaggggtgctatcttaatcttactaaataggaaactatttcccagaagccccacctccagcaggtttccctttgcataccattggccagaaccctgactcacagcctgccccaaactaaacactggccaccaagaatcagattgttagaagtggcttagagtctaagttctagttgaagtatagttcaccttcgggggataagcaggtggccaccttctgtcatcactttgccgagctcatttggagatctgtagacaaataagaaggtggaatatctgttgggtgaatgttatctatgtcttttacggtctgcttccatacagcaatagcctagggcaagggcaaggtcagaaaaattttagctttccaagtggctgtgtgatcttgaaaaagtcatgtgcttttcttctgcagactccagtttctataaaacaaggaggtgggatagatttgtttattcctcagtttattcattcaacaaatgttaatgaagcacttactttattacaagcagtattttatgcatggaggttacaatagtgaaccttccaaagttcttcccagatatcttatgtttttacatgattccatgtgagaagctgtggtcctggtaaagctatgggcgttggtgtagggatggtgtgcacccgtgaggccttctaataccgtcaactctagggggagtttttggacgtcatgggttcatttcactttatttatttatgtatttgtttatttatttaagaatccaagagattgatctggttccttccatttgccttgcccccagctgctgttactgacagggtttctgctttccatattgcccattctagagcaacacacaacctcactgcatttttcttacacttctgcctctgatcccaaaaggaacagatgactgatattttctcagtttttctttctttctttttctttttttttttttaacattgttagcaacagaggaaatagatgacagtggttgttgggggaagcttctctgcccttcacactttttcatcctagcactgtagagaaagataaaagaacattaaagcagaaagagtgtgttcttgagtctgtaatactgaggtattatcttcttatatttttgataaatagccagatttgatgatgaggagggagaaaggtgtgttggaggaagttgactcgtggctgagaacagctgcagcagtcctggggaatgagggtacccccccatcttttaccctttgtctcagccatatcaattcctgccacccgggacactgcctaggacaggctgcagtgcaagtgaagatcaaggactggagaggggaaggggctgtgaaggcaacatcaaaggttttggggctgtgaggggagatggcacagagatcctctgttgagacgctgagtttctaggactttcctgaatctcttttttccaagggaatgtatatatacactaacacatatatatatgcgtgtgtgtgtgtgtgtgtgtgtgttaaatggagcaacaagatgaggactggctcatgatatatatgatttgtttcttaagtgatgataaaataaattctgaagtactgtggtgattttaatgacaacactttggaaaccttttgggacatgtagacagggattacagtctgtgttatctacttatctatctcaggggtcggcataccattcatatttactatcagcaagatagtaaatattttaggctttgtgggccatatggtctgtgttacaactactctgcccttgtagcagaaaagcagccatgcacaatagctaagcaagttggccgtgttccattaacactttagctatggacaacttccttgtgtttccttcagtttcatataattttcatgtgtcataaaatatttttctgttgagtttttaaaaaactatttaaaaatgtgaaaacactcttactttgtaagtggtgccgaaacaggcctacaggctgtagtttgtcaaccctgagtctatctggctatcatttgtttatttgttggtctatctacctgtatgttttccttcttccttctttcatctaggagaagaaatctggttccattaaattttgtatgagaaattctttcctatttatatagtcaactactctaaacacttacaaaggggatagagaataactgatttattggatttctggtattgattcgcttgtgtcctgtggttgaacttgtacaagctttatgtattattattattttaaaatactacatttagcattcttatagccaatttagaataattactttgtaaaagatccttgaggaagtacattacatctaataaaaaattatcttggatcttgttaagacttgaaaaccccaggtgaatgatagcgttgggtcagtttttacattctgaatagagcacgtgttttttctgagtcagacaggcaagacttggatagctgtatattactgtttatgagccttatcctttcctgcaaatcaagtgtttattccactcctgaacttaattagcagctaagagctttgtgctttgtattttaaggaagcatgtgatttgttcattagttcaaaagcagattaattattatatctttagtcaccatctgtaaacacatctatattggtgagctctctcctgctgagttaccttgaaatgccctgtggtgttttattagcttcaattctgtgtttattacagttggctggagatttttcaatttagtttattggccacagaaagtccaatcattctgtggaaactaccaatttctgagagtgaggggtttactagtgctggctgtcaatttgctctaaacattttccccaaatcaaactgtatttctgtttggattaaagatagtagtagtttgattataagctaagattttaagcaccctatatattgtccgcattcaaggaagagcaattgggattaaaattagtaatctgcatgaaaaagtatctttctaatccaagttagctccagacaaaactgtgaagtacgtgaacgaaagaggataaatgaatagttattgatgcctgggcattttaatattatctaattttggttttgcagcaatgctgttaggttccaagtgattctcagagaatttaaagaacttgcataagatcattgatagagctgggatatgaatcaatattagtgtgacttgtgagtttgtgcttctcttcaccagtgtctagattgtcagaaaaaaatataggacacctagtaatatttgaattttatattatcaacaaatacttttttagcataagtatgtcccaaatattgttgtcctaaatattgtgtgggccatacatatattaccaaattatttgttgcttatctgaaatttatatttaagtgggtgtcatgttttattattacttgtgaaatttggaaaccttagtagtgtcccttccttctctctccttctctaggcattaagtctgtccaggaacccctttatctgcttccctgctccctctgtacttctggctttggcttattaaccccattctttgcttctttagtttgcagtttacctgctcaggtaaacttaaacattaactggggaccttattctctctggttttcaaagtgtctagtgactattttaaaaaaggaataggattagcctgtttgtcagagctaatgtcttcagtgattatatttttcaagttatgtatttacttaacacagccatgctttaatgcagggtaactctagaggccaaaatttttagaccctgtgcaaagaaaaagaagagcttaagaccattcttttagttattctgatagggtatttttcccacagaacctgttggtgactttatgtttttaattttatctaaaatttgattattattattattcagatttcttttgcttttgattcttgtatactaaacaaattttgaagacaattttcgtgcatttaaaaaaaactttataaaatacttttcaaagaattagtagatgattgaggtctctaacaattcttaaactatattttcacttagtaaaaggtaacacttttacaatacaatttttatttcttgagtaacaagaatacagagggaaaagttacggttctcagtatccaaccatttagctatataccaacatagtagcagaccagacgcttctcagtgaagctaatccaagccagcaccttatgttctctgcccaaactctaggaaacttgtacctttaccaaaaaatctcagagactggcttggaaaccactgggtaaatcagtaggattgttttattatctagttaccttaaggactttaactggggcctcaaagtcttttcagaccactaagcaggaagcgtgtgctgttagccataatgtggctgcaataagaatgatagttttgggtcagctaacagtatgttatggatgaatgtggctcctttcatctctctgaatcttggctttgttgtctgtaaaatcaagcaggggtgggattgaatgatagccgaggtctttattagtttgttactggcttcaacagagttgggaagcctcaagccacatgaacctttctcagaactgcttctcaggacaccttagggtagctgagtgattacaaaaagcatctgaactatgtgcagatgccttggaatagaagcaggggatctggaaaggctgttccccaaggtctctgcagtcagccatgcacttagatttgactacagacaaaacagatgtattcaaaaaattgaatggcatgttttacctaaatggtaggggttagggaagatagcttcttaatgggtctttgtgccatgtctctttattccttatgattagtacagctgaatcctgattctctttccttttccttgtcttccttccctctcttcctgtctctctttttttctccctccctctctcattgctcatttttttccttttcttcctttcttgccactctaacaggctgagaacaggacttttaggagctagctttccagaagtgatatagttacattgccttatctggatttccagagcgcatttctcctcatgtgctttttcgcaagagagagaacataacataagcccctaatcctttcaaatatgttaaagagaacaatgctgtgattgaagcaaggagactgggatttgactctcgtgtcttcctcttacctactatttgtatggctattgaagaagtcactgaatagatttcattatatctaaaatgtgagtataatcctcattgaactcttaggatttcattaacactgaaattctattgaaaaacagtttttaaactgatataccatggaaattattttttcatgtgcctaggtaggtttgttttctttcttctctctgtaattccagagttgttataatgtgtctttctctcatgctagactctaaattcattgagagaggaccttgttttattcaccttttaagttttaattaataagcctatagaacctataaaatgagtcagcatttagtagggtcttatgtgtactaatgtgtctgaaggcatgtacacataaatttaactaatttttattttacttatgattctgtccagtttttaatacaatattaaaacctgaggaaagcagaatatttaactttgttattatagttgattaaatactttactgtctttttgcatattcaattatctgtagcttgtgcagtcttgtaagacactggttgtggtactcactcattcattcttaatccattcatctatccaaccaatagttattttccccattaactgtcctctgaattgtgctaggcacaaaacagatgtaaactctgacatcatgaagcttatagtcaatggaggagaaggcaataaaataagtaaacacaaatgaatatgtaatggcaaagtgatataagtgttagggagagcatccggtttcaagtgaatgagaataacagtgtcacccactctagaatggatatatttaaattctttgaggaagtggcactgaagctaagagagatctactcttgacgatgattagttcttggctagacaaaaccaaaccaaaccaaaacaacacaacggatgaagagtggatcagacatgttacatggtacatacagatggagtatcccttatccaaaattcttggaaccaaaatcctttgaatattttcagaatatataccagttgagcagccctaatttgaaatccagaatccacaacccagaatgctccaacgagcatctcctttgagcatcatgtcggtgctcaaaacgtttcagattttggagcattttggatttcagattttcagatcaatgctcaacctatataatgctcaacctgtataaaggccctgaggtaggaaagagccatgaggactcaaagaattgaaaggtaagcatgaggaatagtggcatgagggacggtgatgctgttcatagtgcccaattccccaaatgttttattcccttactaaattactccgttgtagttgctttttttggtgtttcatttttcaacatcctcatatgcctcctttcttggtaacagctttattgagatataatttacatatcatacagttcaaccatttaaagcatacaatttagtggtcgttagtatattcacagagttgtgcacccatcactacaatcaattttagaacaacttcatcgctattctctttagctgtcacccctaaatccctccattcccgatgccctaggaaaccactaatgtactttttccccatttatctattttggatatttcatatacatggaattatataatttgtgatcttttgtgtcatgcctcttttaacaattttctattgcatgttcatctgcttttcatctttgctcccaagttaccgcagttatggacttttttttgccttcagtgtgctaccttgttccagtgaagttatttctctttttgtttccctacaccattagcaatgtccaaacttcgaagagtttccatattgctaaatgaagtcataaaatttatattaatgaaaagttgtctttctagtttcttataatcgagtgtttagaaatctttacaaatcaccagttggttatttttctgttgctcaaatttgtgctctttcacctaaaagaattaggaatccaaatgagattttgtactataatagacaaattgcacaaagcttccatccacctctaaataaaaggagaacttcgtcagcatacattttgacattttagatggtatgtgtaaagaacacatacgtacccaaatctcttccagtgatttctcaaaaggtgagctctctgctttaaaaatagaacattgatgattcagtgcccaatatttgttagtatgaacttaaaaaatattgattgattgataactaatagcaaaatttggttgttgggtagatatctgcagtctgctgaaaatcaaaatgttatggttaaagaacgagtttagtagcactaatcagaattccttggtttcttgggaaattagggggttgctgctttactaccaaagaaaaggaattaagaagtattaataatcttcatttgtttttggctagacaacttgtgggatgcagtagggggtagagtgtatacatactattaaactatcttctgaaataaattgtagagggcattttttgaaggcagaaaaggaagagtcagtgtgtttcctaagccaaagctttggtcattgtcactactccctttctgttaagcaaaggacagaaactctgatgttacgaacaagagaggagggtgaaggtgaggcggtgagagcctcagtgctagcaaagggttttagacgcacactccctcatggagagcagatctagtcaggcagtcatgttcacacatctttggtctttgcactctgagcaatacaaaatttaagaattatggttggaattatagataattgggagtcaaaatttaagacaccttcttccccaatatgttttaggcaaagaagaggctggcgtcaagtatttaagagctattttagctaatggcaacagatagattatggagaatcactgcttgttctgtgggccaggtggtaattacagacttagagatataagagttgaatgtgttccattctctaacaccttcacacgcctctttttgaaattctctattgcgtgttcatttacttccctccctttgctcccaagtcacagcaattaagggctttttcttcccttcattgtgccagtgtgtcccagtgatgttatttctcttttcttcagacaatgagtagcttccaaaatccatgatgatctccaaattactaactacagaagtcaaatggaactacattcaaggtgtttagaaactctcataagattgtaataatatgaagaataataggtaaaatattttgtcatatctgaatatattcaaaagttgtgattgaagtctttttttctttttgtttttgtttgtttgtttttaagagacagggcctttgtctcactctggtgcccaggttaaagtgcagcgggtgatcacagcttattgcagcctccaacttctgggctcaaatgatcttcctgcctcagcctcctgagtagctgaaaccgcaggcacatactaccacacctggctttgattgaagtttttagcctcctttttgtgggatccaaaaacattcctttctgcattatgtggaagaaattaataattttcaaaaaagacagcatgttccttcaactaagtttattcagaaaatggcctgtattcattaaaagaccttggctgagttctttggacctgtgaggccttagttttattgtcagtaaaataaagagttgggcctagattggtttttagtaaggtgattggtgcaagaccttttcaaatgatattgtttctttatatcagaatcccaatgtgccctgctcccccttccctaaataaagtgacttattttttatttgattttacttttgtatagcaccctaaggttaacagtctttcaaaataactctcagaattaaatcaactggctgtgaactttgggccctgtcctaactgagtcctctggtctttaatgtagctgaaactgctcaccatggaaacagctgatagcagtggtctgtttgtcaaggaaagcaaatcttgattcagacttcttcccaccctcagctcaccatccttagcttctgtcacaaattgcattggaaaatacattggaaaaacacaaaaacacagaaatatgaactctggctcaaaatagaacaaattccacaaaaattgcccatggcatatcagtaaaatacaggattaatcacaaaaaataattatagtctttggacatatcagaatctcataatatatttagaactgttcattcctcttatcaccctcttaagaaaaaaaaatccactgagcatttagttaagcagtggtgatattctagatgacatgtgagaagacttgtcaaatatccatgacttgaaactaaaaacagcatgacttcttgtcattttagggagacttaggagctaagtctggtagctttggcatcagcttatttttagcagtgtgtgatgtctgtttttcctggttattatccctgggctcaattttgcaattataggatgcacatgttattcagcagatatgaacgttttcacttagcaaactgtgtacgtgaacacctttttaaatgacttaatgggctcgagttttgttggttgttttgcatttaaaatggcacttgagacagataaccaaaagcataaaatggaaaaagtgattattgtagaaaaatgggaaagcaacatgtttctgtaaatgctttcgtgtcgcttactcagagaaacaccatttgactattggaagttgctatgggaagcatgcaacatttccatggcgttacattttactttcttatttgcttgcttgcagttattctttaaaaatatctatatctatatatctgtgtgtgaatatacacgcgtgcacacacacacacacacacacacacatctctagcctttcatccatctattttttttttttttaatgtgtctgagcaccacttcttaggcaaggtcaacacagtaaaactcagctttgattataatgttcaccctcctggaattggtccattacaaccattgtgtgaataaccttgtagaagtttcctgtaaatgtgttggctccttggcaccatagtgttctcagcgttcatactgtgggactgctttaaagttcaactccccttagcaagagccttggtatttcagagactaaattatcttgtggctgagtaatgccaagtatatacctgctttattcctaattctgctggatagcatattattttttattaatgtcatggcatatattagttattattcaaggactgctagggaaagaaatgagccattggatgaccatataaattcctctataactctgatagatcaagaccaatggagctagtgcttaatttccaccattaactgtactgtcattatcaaaattcatggattgaatatacatagtttagaaattctcacgcatgactctgtttgaagcagtagtaacttcatatgaatttttaaaggcagaaattagttacaaggactgcataaaaggaaaaaagcagatcagttgtaagttatcaacatagtgaacaacattattactcattcttaagcactaggtgtgattctaaatcagctttctgtttctagttctcaccctcatctccatgcccgttcttaccctcacccaaataatatttgactgataccagaaatattcttctctctttatttgctacattagggatttcagagggaattcttttcatccaggaaaaagaaaatcaggccagttttgaggaactaaaaataaagctatgcaaaattgttttcaaagtggaattcattgccatttgtttttatgcatgacaatcctttagaatatagcattgaatcaaactatgattctgacttcaatgatttttatagtcagtttacgaatattcactatagattttcttatatatggtttgtatctaaacagatctaatttaaatcctggaagcatgatagtaatagtagtaatggtagtgatataatgagttcatcatatgtgacagactgtgataaattattttacatctattttctccttaagttctcactacctttttcaagtggatactgttcaccccatttaaaatgtaatgaagtaggaaatgtcttactattttgacaaaaatacaaaatcctcttaggaagataattgtgtttgtttgcaaaaatttctttcttttttttttttttttaaaaaggtagtatttaccatattcttttttttttcttttttttattatactttaagttttaggatacatgtgcacattgtgcaggttagttacatatgtatacatgtgccatgctggtgcgctgcacccactaactcgtcatctagcattaggtatatctcccaatgctatccctcccccctccccccaccccacaactgtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacagtttcttaatccagtctatcattgttggacatttgggttggttccaagtctttgctattgtgaataatgccacaataaacatacgtgtgcatgtgtctttatagcagcatgacttatagtcctttgggtatatacccagtaatgggatggctgggtcaaatggtatttccagttctagatccctgaggaatcaccacactgacttcgacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgtataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttctgctgtgcagaagctcttgagtttaattagatcccatttgtcaattttgtcctttgttgccattgcttttggtgttttagacatgaagtccttgcccatgcctgtgtcctgaatggtaatgcctaggttttcttctagggtttttatggttttaggtctaacgtttaagtctttaatccatcttgaattgatttttgtataaggtggaaggaagggatccagtttcagctttctacatatggctagccaattttcccaacaccatttattaaatagggaatcctttccccattgcttgtttttctcaggtttgtcaaagatcagatagctgtagatatgcggtgttatttctgagggctctgttgtgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaaggcattggtagctggatggggatggcattgaatctgtaaattaccttgggcagtatggccattttcacgatattgattcttcctatccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataggaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacagtatgttgaataggagtggtgagagagggcatccctgtcttatgccagttttcaaagggaatgcttccagtttttgcccattcagtatgttattggctgtgggtttgtcatagatagctcttattattttgaaatacatcccatcattacctaatttattgagagattttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgagaatttttgcatcaatgttcatcaaggatattggtctaaaattctcttttttggttgtgtctctgcccggctttggaatcagaatgatgctggcctcataaaatgagttaggaaggattccctctttttctattgatcggaatagtttcagaaggaatggtaccagttcctccttgtacctctggtagaatttggctgtgaatccatctggtcctggactctttttggttggtaagctattgattattgccacaatttcagatcctgttattggtctattcagagattcaacttcttcctggtttagtcttgggagagtgtatgtgttgaggaagttatgcattagtactagattttctagtttatttgcatagaggtgtttgtagtattctgtgatggtagtttgtatttctgtgggatcggtgatgatatcccctttatcattttttattgcatctatttgattcttctctctttttttctttattagtcttgctagtggtctatcaattttgttgatcctttcaaaaaaccagctcctggattcattctttgtaagggttctaaggagaccatgagccctgatctattaatacctgtgtgcctccctctccctctctccttgcaaggacatcttctgctggtgccaagacatcagaatgagatctagattgcaaatggtgtaagaagggtttagaactcctggttttaggagatggagggagtgtggaatagagatgagagggagagaaagaaatggagccaaatagcaagatggtgggaagctgtagtgagagagagagagaggtgtgtgtgtgtgtgtgtgtgtgtgtgtgtgtgtgtgcacatgctcatttagttatttgggttttggctcaagtggatacagtgctggagagagcccaagaagcagagtggggcaggctgcaacctttctaggaactcctttggacatgcaccagccaaaaaattaggggctcaagtctatttcattaagaatctaggttggcagggaaatgcccagggacatcgctcacatcacagtgtaagaaattgagaaaaaatgctctcctgaagtcattcaattaatcaggggcaaggatggaatgcaaagccaagtctctcaattcagagtactggattctctttattataccttcctggcactctagaataatgattctagcatgagacatggtaatctcaacaaataaatgctatgattatgtttatgcttactagcagttctagtaatcttccatttctaaacttggtagtcaggtaatcagatgtgttaaaattttcttttaaatgattcattctagacagtggaaagtatgcttaagaatattaaatatttaattttattgggtatcaccatcatataattataatctggacttttttttttttttttttttttgagacaggctcttgctctgttgcccaggctgcagtgcagtggcacaatcttggctcactgcagccttgacctcctgggctcaagctatcctcctgcctcagcctttcaagtagctggtactgcaggcatgtgtcaccacgactggctaatttttgttattttttgtagagatggggttttgtcatgttgcccaggctggtctggaactcctgagctcaagcagtcctcctgtcttggcctcccaaagtgttgggactacaggtgtgagccactgtgcctggccctggacttcttatgacactttattttatcctgtggcaccaagtaattatgatgctttacttataatctatacacactacgtttgctattccttttttccgtgtcagggaaaagtaaagtggcaagttttacaaactgttttgtaatatgttggactgtatgagacacctctagtaggctgaataatggcaccccataaaatatccaccttctaatccttggcatctgtgaatgttacctcatatggccaaaaaggattttgcaaatatggttaaggcagggagattactctgattattctgtattgtccaggtgggccctaaatgcagtcacatgtatcttataaagagggagacagaggggtatttaatacgtacagaagggaagaaggcaatgcgatcatgaaagcaaagactgggcagcctccggaagttagagtcttcaaggaatgaattatctcctagagcctctgggggagaacagccccgccaacaccttgattttggcccaggaaaactgatgtgggacttctgtcctccagaactgtgagagcatacattctgttgttctgtggcacaacggttgtggtcatttgttatggcagccacaagaaatgaatacaacactgtggagaagtgtaagcccataagcaacctcagtccatgatgaaagccatggctagatgtaggtgttttcccccaaagccagggtactcattactcaaataaaattcatatcttcccaaaatgaaatctgcaaacatcccgggacccttctacctgggaaaggaccttctgataggaaaacagtgacagcatattaatctactgcttggggaattcttggcaacagggatatggcctccatcccatgggagacagaactggcaaaagaagaaattgtggatattgttgtattttttaaagatggaaacatctgcataaaagttattgtacagggttttctctttgagcccacaaaaacaagaaaaaaaatactgtcttccaccgaactttaaaaaagtcactcttagactagatccagattttatcccatctcttattattttacttcaaataagcaaaattaggaaactgtcaatactttgtattatgtaggaaaaattgttatacattatgcttaggctattgattagtgaatattttctttttagctgtgcagttactatatccatctaattatgataacagatttttaaaataagttattggttggtatgcagtatttgaaagaatgaaattaaccttttcctttcattatcaaggattttaacttacatgcctatgtcactgaacatacacatatatagaatacatatatacactgaatatatatatatattctgttttttatttgaagttctttagtaataaaatatcaccttaaaaacaaagcaatttctttgacacagcatttaatttggaggtcactcatattttaaatggggagccaaactttaaagttttttttttttttttaaagagagtgtctacaatagaatttgacttcccatgccttcataaagctaaaattctcaatgagcagcatttttatttaggataaactggcctctatgaaaacaagcatcttcagcttttgagaagttgtgtgccctgattagcaagcaagccacactagactttaaaattgaactgagggccctgctgaagcacagcttctattgttctgtaatgagtgttttgcagagtcctttcaaaagtaaactgtattgttcccttgctagtttcagtacatctgaatgaggtgattatgttccttaaaaagcactttcaggactgcagaaaaattatctactttaaaaaacattttttccctttatctggtgataaattttaaaaccttgaacatttcatgagcatcctggcaagaggtttaaaattatctggaaatcctgcctttgatccaaggtgcagagagtctaaaaacccatcagagcctataggcaggtctctgctgcctgagctgctgcttgagcaggaaattttgcatagtaaatactttaaaactttggtattcagagagcaatattaaatctaggtgaggactaacatctctgaatagagcaaaatttcatgatgccagggtacttgtatagctattgacagcctagtttttcaaataaaattttaaactgctggggcacttggagtccatttgtatttttctgatgcaatgtccgtggggctttcagaatagcggggacacgggtgggattggagctcttttttttaacctcttttcatttccacatgtctgttattcttagtgacttgtatcatttccgtattaccaagttgaaacagccacaatcttggccctgctgtcaataaatttgttgaattatttattcatttcatttatttatttatttcaataaataatgtcttagagcaggaccaagactgtggctttatagatttgaaatattttagggaaagcagagtttacaataaaggaggcaaatattggattggatctagaataccctatcagttcattgaatcataatttccccacataaaaccttgggttcttaatttatcgaattgaccctagtcctttattgtgtcaggacttttttcctaaatcctaattgagtgacaagttctatttgaagaattccagcacttcaccactctgtgtgtagatgagttatttttctgtctcctagagagtatagagcaaggctacaaagagcctgtaccccaagggtctcctgcattttccgatgcccctaagcatattttaggtgatatagaaaggattagacatgtcttaatttggcccaaataagtaacttaatttggcccaatgaaacaacccttgaaatacgttgtgtttccaaaacaatcagtaagaggagagtgatcccccagggagcccctcacttctcctgctcatccttctgtccccccagtggcaattttcattcttatccctgaggttcttctccctattaaaaaaatacacgtttgaagatgaaatatactggattcttgtgcagtgccatgacgtcttatggagacatctgttctgttgttactgggatgaagtgaacgtcaccacatggaactttgttgtgcctccctcaccatgcaagggaattagagttttgttaattccctagttgtttctctgctttaatcagagggacaactggtcagagagttttgtccttcctgggaccagctcattttaggccattctaatgactttgcagcttgcccttgggcccaggcctttgatttcaggtggcccatagggctgcagacttttacttcccttgaaatgaacagctccatcatccatcctcctagaggacgtggcgggtcaagactattcagcttcacgttcacaacttctgcctcctcctctccctgctcccaagtgtgtggcgtaaaccgatagcagccaccattatatgatgctgagggagcctccttccttataaccttccgttgtaacagctgcatccacagaaaccctggacttagttgtgagatatattcagtccctccagggcaggggatgtccttcagttccatccttggatccctagttttgaatcacttttgatttatagtaacctgggtgagatgcttccaaaactccatcccctgctgcttcatcacctaaatgtgacactagggcaaagatctccccctgcttttgtaaactggtctatcctgtgcacctacgcctattgtcaaattaataaatctctataatggcatatttgtattttgtaggaattgctgatagtaattcttttcagaacctggaagaacattcttcaaagaaatcaggaaattaagttatattacttgttaattcttaccacacaactgactacattaagacatttttaaaaaagctctatgcgtatgatgcttttggtcagtctgattatgaaaatggtatgttttagaagaagttctatttattgacagggtggaggcagaagctgtttttatattaccatgtcatgtttttaagtatgtaaataagatgaattgctgctatgatcaagtaaaaattaaaagcaatgtaataaattcatagagagtgagtgtttcttgggaggccgaggcaggcagatcacaaggtcagaagtttgagaacagcctgactaacatggtgaaacctcgtatctactaaaaatacaaaaattagctaggcgtggtggcgggcacctgtaatcccagctactcaggaggttgaggcaggagaattgcttgaactcaggaggcaggaggcggaggttgcagtgagccacgatcgcaccattacactctagcctgggtgacagagcgagactccatctcaaaaaaaaaaaaaagagtgtctctttttattttacctattaatttggtgcacagtatggctgtgcatgatgtattcttagtgtaggcattatacaaaaatcctgtgccatgtggcagataatctcattagaagaagaaaaaaagcctaaatcgacatggatcacctggtagtgtcacagtcttctctattgctggatctatttatgcaaaaaacataaaatcttcataccctcacgtctatctacatgtcacacctggttttgattttaatgactttcagactcttcagtgggaaggaaataaataataaaagcagtgttattgaaaaattctggaaataaaaacattttctgattatgaataatacatgtttattttagaaaatttggaaataaaaaaaaggataaacaagataaagtcaccttaaataccagctctaagagggatccattaacactttgaggtattttcttcccacagttcatggaaagtgaaggcttctgaactgcttgttgttcctcattctttgttcctgattactgtaactggaaccttcttctggtccaccaaatcagaaaccttcggggttatcttggacttcccctttcactcaccctgtcatcttttggccctgtgggtcctacctctgtggatttccctgcccattccctctggttcaaccccactcctattattctaattcagtctccctttctctcttatttggaattctgctgcagctttctgcccagtcttcctgtacctagtcataccctcctctgctatatgcaccattctgagaccaccatatttttttttccctaaaagttaaccctatgatgttgtactcttgtttaagcctctgaaagcctctctgctctccttttcgtgatctgccctgataagtttcttctttccatctcttccttagcctcactctctgccttttctctttccatctcctctccagccatcatctcagtcactgtgctagcagtttctggatcatcctctttttttgcttgcacagtcacacattctgttccctgtaccttttcttctaaccaccttgaagtttcaaactccctgaggtctgaggaatgaagtagaaagaccttgtgatactgtatgtttattgtaaaaatgtattttgaatgacatctttctgttcctcctgtagaagtcagcttgtcatcaccgactctgggaacactccctagccacaaagacttaagtttcacttgctttgtgtttccacaatttatggacaacacttagactttaggtcagtaagtgatcctgaagatttattcaggtgacatccctgagaagcaatattttaggctgattttatttggacagtcaacaattgatatggactatatgtcatatgtcaagcactgatctctgattcctgtgaattagacagacataatctttgctttcatggagcttgtagtctggtatagtctgatgtaggcaagcactcaataagaagcaatgaataagcaagataatctcatggagataatttgaagtgataaatacagggtgatgtaatggcattgggtgcagttatatggtttcaagttgactgagctggtaagggctgtgctgtagtacctaccagtatattatccagacatatgtcaatcatattactaagttaacagcatttggtagtggaagctgtgcatatttgttgggctaatggttttagggttaaaaccttatttgaatgaatagaggatatttaagattggaaagaaacatgatagcattcaaataattgaatgactatatattagtactataacaaagagattctggaacactccagaagactgactggagcaaaccaaaaaatagaagttacagaggggtatattttaacttaatataaggaacatcttttaaatgtttatgattttctcatcaatagaatggatgtgctgaatctttgataggggttgtattcagataccggtgatctgtcagaggtgagtgaggaagttcctctaaaggagagcaaagtagcctagatagtttcagagatctctattgtgttactttgaggaagctcaacctaggagaaatagaggtatcccgagaggagcaaatttagggcagaacagaaagaccccacaaaagaggtcaatggaacaagagatgatatttctctggaaaaagggcacatagcaaatatataagactgttgattcaccagcaaaagagtcttcatgctgattggttgggaaaaaaaggaaacagaagaaaaagagatcaagaaaaggaaatgtcttattgaagaagagggaccctatcaagtaattccagaatgctgaatgctgtcatgctctgaataaatacggcatcaattaaagggataagagctttgattataacttaatgtctggctgagctatttcttacatcactgtttcttaggtaatagtttttagtctattatctaatagtccattagtacgttgaatagtattctataaatgaatctagaataatatgtttaccttccattttaggtatgatatggcaactcttcattttcaatactcacagtggttgattgagacataaatttatttgggctcaggcttggcttggtcaggaaaacaacaaaggaaaaagtttttcttcagagctgctatgtttatgcttttatgttgtggttggcattttggcagcataggtattaagttatgtaccacccaaaactacttaaaattagttttctcaggcttaaaagaaagagaccttggttttttaagacattgaataagctttagttcagcaacaacgggctgcagaaacaatgcttttaacttttatttgtgtcatatatttaagttacacattattttcgattcttcttgtatttattttttccttctagcgaaaacaatttggttccagtattttaagttattaatgcttcctagagaacaagtttaagttttccagtttaggaggaaaagcattcaaatcagaaaaccccctcatttttaacatttttcccaagaagcagaacagtcattttttaatcctctcataatgccctgggggcgttagacagacattgtcccttaaaaaagagaaaaataggaattgcatcatgtttgatagaagtataagtaacaagggaaaaatatgaaaccacaaaaagtggatttatttttttcctcaatatttgcatattttagcaaataggtttattgagcctcattggtggagggttgacaaggatatgtaatgttattttgtctatttaacaacttacagcttatttaaactctttttcctaaatgaatcatctccctttttttttgtctgaaaggtgacagtatatttattatggtccattttgtaaatacccgcttgcaaatagacctcttcatacctgggtgtgcctctttggagacatgcagaagaaaccctcccaatgtgaattacttcttgactttgcagacttaagatgaaattgcttaaaataaaaggaaaaataaaaatacactgcttgttttagtgtacatttggaaggttacaaaaattggattaaatattgatgtttgcttttaggtatttttgtcttttaattggcaagttaatagggatactttcttgggtgagatcattttctgtgaacttgggaagaatcagtttgcttgttcgctggtggacacatggaaaatacatcattggagcatatgttgtttatttttttattatgaaatattttagcaattcagaaaaatatgaataataaatttaataaatactcatctactcattatatgtttatgttttgtcttacctcaggactcattttttttttaagcaataaggcatttaaaatatagttgaagtgctctttgtaaaatttcactcactgtccagagttagccattatcctgagttgaatgtggtgtttaccattcccatttatctattcttttaaatataaaatatttattcataaatattacgatattatttcatatgttcttgaactttatatatgtggtatattatataaatcatttttgattttattatgtcattaatttactgtaagtattgaggtgtatccattttgacatatatagctctaggtccgttgtattaattgctgtgtattattctaatatataaactgctacagttttcacatattcattctcctgttgatggacatctagactgtttccagaatttctgttctacattgtcttgctgttaatatttttgtgatttttctcaagaagatgttggggaatttctctaggagtggaattgttgggtcacttactagtttcctattgctactgaaacaaattatcctaagtgtgctggcttgaaacaacagaaatgtattatcttcgagttctatagatgagaaatctgacatggttcacactgggctacactcacggtatccgcagggctgtgtttcttctggaacctgtagggaagaatccatttgctttccttttttggcttctagagagtgctcacattccttggatcatggtctctctcctgcatcttcagcaggactgaagaaccagcactgctgcatcgactattattccataggcacatctccacttctgcctgactgtattctgcctctcccttctactttatttatttatttatttttgagatggagtcttgcttttgtcactcaggctggagtgcaatggtgtgatcttggctaactgcaacctccgcctcccgggctcatgcgattcccccacctcagcctcctgagtagctgggattacaggcgctcgccaccacgcccagctaattttttttgtatttttagtagagatgggatttcaccatgttggccaggctggtctcgaactcctgacctcaggtgatcctccctcattggcctcccaaagtgctgggattacaggtgtgagccaccacatctggcctctcccttccactttttagaatccttgtgaatgcgttgggccattctgaataatccaggataatcttatgattttaggtcattttattagcaacctaaattctacctgcaaccttaattccccttggcatatgaggtaatataatcaaaggttctggggatatggtcatgaatatctttgcagggggagggtattgtacctacacagatcatagggtgtcatacattgtccacttgacaggatagttttaaattgctattttaaatggtgtgtgcatttatactgtctctgaaagtgtatgaaaattttaactgttccatatccttgccaacgtgaggattataagactttaagatgttacccaattggatggatgtgttttggtatctcattgagcatctttccatataattattagctgctgaaattgtcttttttatttattgcctgcttctgtccttttcttatttctaaattgttctttgttttgttttcttactcgtttatacataagaaaaaagaaaagaaaaaataattagtagttaattataatatttaacaacatattaattcttataataattaataattttttctttttttttttttgtttagagtcagggtctcaccgtgtcactcaggttggagtgcagtggtgtgatcataactcactgtagccttggcctcctgggcttaaatgttcctcccacctctgcctcctgagtaactgggactacaggcacgtaccaccatgcatggctaaggttttttatttatttattatttattatttattattatttttttttgagacagagtctcagtctgtcgcccaggctggagtgcagtggcttgatctcggctcactgcaggcttcgcctcccgggttcacgccattctcccgcctcagcctcccaagtagctgggactataggtgcccaccaccacgcccaactaatttagtttttgtatttttagtagagacagggtttcactgtgttagccaggatggtctcgatctcctgaccttgtgatctgcccgccttggcctcccaaagtgctgggattacaggcataagccactgcgcccagcccagtttttcatttttttaaatttgtggaaatggcgtcttgctatttttgcccaggctgatcttgaactcctggtctcaagtgatactcccgcctcagcctccccaaattctgggattacaggtgtaatctaaagtgctcagccataatcccattactaattcttgttggttatttgcattcccatatttttcctagtgtgatttgtctttgcactttattagggtttttttttttttttaagtgcacaaatattttaattcaaagtcggcacgttctgccatttcctacttgaagtaagatatccctcttcatttttaaataaagagcaccattatacattgaaataattttatttgtatctagatatatatgtttctattttttttttgagatgtagcaacaaaacagtctgatttattaggttggtccagttttatataggccgcaattgagaactgtgtaatttaaagagtgatgggtttataaaatgttattgctagcaaaaactttagagatgatctggtctgaaactgatgtccagagagacagggaatggcgattctagaagcgcttgtattgacaaagtgaattgcatacacactgcaatattatcttcgttggctaagggactctgccttaccttgaaaagcatgattataaaaataataactggacatcaattttgctgagaatcttctcttatctctggagtgcatattttctattgtaaggcttttgtcacaaacatacctctactgtgagccaggtcccaaaagggacccttactttagcaaagtcccacaacttttctgtctgggtattcatccacatcactctctgttccaacactgctactcctccaactcactaaacaggttttattttcccaatatcactcgattctcagactcttgaagatcagagataaaattaagtgcatcttttatgcccaaaataagtgtgtcaagattttttcactatttttttcttaaggaagtattgcagaggaacttaagagtgagtgacagttgacaaaaagaaatggttgcctggaaactggcaatttaaataactaggagctgatatgatttaccagcctgataaacagctaggactttaatacaatctaaagggctgctacagatgttggattgagctatttatatgtgttaatctgtctcagtctattttaatacatgcatatatatatgcattttttttttgcagaactggaatataaaagcaaaggctgtatctcttcccctatatgacattaatagaaataatagaaattgccttcaattaaatgaattgttttggtccccttgtttttatatagattttcagtttcaaaggtggctttctcactcagggggaatagatgtcttgtggattgagtgcggagtttgttttgagttctgacactgtaattatatacttagtaattgttaccttgttttttcaggttttatcatttgaaactttactccatttgttgagatggagttgcagatacttttgattcttcacaggaataatgaggtttaataggattggttctgagtgagttagcttaatcaagtagcctgttttactgatgggatcattaagaggctttatcctctcatgggccagttagtttcctggagcaggtgaatgtctttgcagcctccttgatcctcactagacatctttcacatggttcttcgaagagatgatagaaaagctgcagcctatattgtactgtaatcatagtatagtaacccagagttccctcttctggcaggaggtcagtactatcattttgtgtataaataactgatggcatatttgtgaagctgtctgtataaaattccactatctccttgggaatggaatgtgctacatacaacaaactatcatcatgttactagcataaaacttgagataattttgaggataattttgacagtggaaatgttttatgatatgaggaatataaaaatagatcatttaattcacagaatagttgaaggacacagcaaggtaatttttaaattgtttcttgcaattgtttacaattcactgagcgtagtagctatgacttggagaacttctgggaaaggaggacatttttaccacccatgcatgtttgaataaatttcagtctcctaaagctgtgcaccagctctttcatgtatcttcccttctacctctaatcacagtgagaactccctactcctaattcctgtagcacttgtgctgtcccatttttttttttttaaagaaaatagctatcagggctgcagtgtttcacaatttgaggggcagtttgtaacacagaggccctgaatgtcataatgtctcacatatattgagcagtatgctaagtattttaaatatattatcactcatccctagtgaccctgcaagtaactattagagccagcaacttaccagtgaggaaactgaaggtcagaatggtaaataatttgcctgtgaaaatacggcaattggaatttgcattaaggtcagccagactccaaagtcagggttcttttccttgttctgctctctatatatgtttgttattttgtttcttaattgttcatatgcatatgttgtttctcttgtgcttctcatactttagcttagttaagaatcaccatggaaacttgtttaaaatgctgtttctgggcccttgtcctaaagattctgattcagaaggtctcagataagtcctgagtgtctgcatctgcattttctgaggggttcttggactgtactctgagaaatcactggtatgaaatctgggagacaggagctatctgaacaactcccccagctctgaacattcatagcaagcactcaataagtacatgttacattcaagcagagctaacttgctcctgtgcaaaatatagcccacaaggttccatagcatgaacttggattgttcttaacttgaatataaagtttgtgtaagttagaaaagtcaatactaattatagggtgaagttcaaagaacaatatctgatatgattcattttttacaaattggtgtattctggaaatttaggtgtatcctaaattaggtgtattggtgtgttttcacaaggaagtttctgtagacaaaggaacagcattggctagaaaagaaccagagagggacggaattgaagttagttgtaggtataaagtagggttctttggaaggggaggaggagatggagataaagatgggagatgaggttggttcaactcattagtgaaggtaagttctttggaaaggggccaaataaccagtggcctaatcaattgcaagggattctggagaaacctagtagaaaagagggtcacagatgtgttagcggtgaaaagaattggaccaaacgcacagacaaagcaaggaaagaataaagtgacaacagcagagatttgctgaaaatgaaagtacactccacggggtgggagtggcctgagcataggggctcaagagccctgttatggaattttctggggtcaaataccctctagaggtttcccattggttacttgatatacaccctatgtaaatgaagtagcagcccacgaccagtctgattggttgcagaaagtgaccaatcagaggctgaagtgaagttataaagttctgtacaaatgaagacttggccctctaccagcctgattggttgtgggaggggtccaattagaggtactttcaattcctcatctgccctgcagaaaaaggtggggagggttgcaaagggagtagcctttggtcctttcgttacttgagcatggaaacttggggttttccttttgatttagttctaggaagtcagtgcaaatcggctttagggtccctgcctctagaacctattctcctgcctcagatggagggataaggagtaaacagaatcagtgccaatgtgggtcttggctggggagggtgccatgtacctcacatctttgggcaatggccctggtgacttaagactcatactggtttccttctacattgtgtgggtattttctgttatcacttcttcacctgaggggcacatctgcttgtgcctagagatgtgtcttggctggcttaaaattgtatggactgctagcaacaggtagaacagtgagtaaaacgatcagtgatatccttcccaaaatagagggaccttaaggtctattgaaattcccaagccaatctgttaaaacatattcaagttctgtatagaaagatctatacaatatccggggaatagacttcatgcttcccttcacatttctataaaatgatacttgtttctaacttacagtttttttttctattcgaatgtttttctttctattaacatccaagtgatttttttatatagctaacacgagtgaaagattaaagtaaacatggtatattcacaagcaaaggatagcacagtatatttccttagagtacacatttgccttctaaaagaaagaaaaagaatgaaaaaaagctttagtaattagatacctgctgtaaccctagtggagtgagaaagatgaatagttgtgctgcaggactctgtgccacagtgagaggcactatgtgtcactgttttctcttgggatgaaatttggcctgaagtaaaataaaatttctgtaatgataataacagccaatgtttttgagcaccttcaccttaccaatgattactttacatttatttccttcaagcctcacaatgacctcataagttaaataattcatgtttaagcaactgaggctcagagaggttaattgacttccagaccgcctagctagtgaaacattttacaagagcactttgctcaacgtggggattatcagatcttcaagagttgagttgcagcattaaagaaatgtgattaaagaaatcacagaattttaaaaaatgtacacaatattgaagcttgaaaaagagaatcatatcactcttaattacaatgatggctaaaggtcttttgtgtttggctagctgatcataacccatgcctccacgcaggtgaggtagtagaccaggggagacgggttcttttcaacatgcttggtcggcagttttctgcagggaaggttatagcgtgtgagttacaaagccctcctgctgcacaggtatcagaggttgtctgttacaagttccttcacttcgactattacttccttttcacaattctattttggacttctgtccagtgtgtatttacaggtagacaaagctttttttctttctttctttctttctttttttttttttaacaacctctttgccatgactgaaaagaagcctgtatatcctgcagtttctgggcattgtgagtctccttttaaactcaaattggtgataatggtgactgtgactccctattgtccaaggaggggagttgcagatagggccttcaaagatgatccaataaaaatcagtgcagtaagactttttgataaaatgatctttatgatgtagaggcatttggaatatgggttgggtactggataccctggggctaagcccagtgtttaaaaatcaaggcttactacgaaaaggtctgtttttattagtgcaggtactgtagttggcaagatttcttcttatgaaatgcaatatccagcagaccattcctgattatgttatgtatttttagatgttaccattgagttatatttatagtatagactactgaatcttatcttaaatatgcaaaatatatgcataactaacctcccaagctgcgttccctgctctatattacacccaacaatgtagcctgttcttaaatggttctcctaaaagtcttagaatggagcttattatttgcttttaaaatgtaagcacagagactgtgtgttagatgtgtggccttctgggtgacatgttctgctcctagatactctaagggtgaagtcagcaaacctttggcagtgcaggtggggagtgaaaccaatagtcttgcatagataactccccagagtccagaatgagccaaaagtaattgatatgccagtctttgccagcatgtttggtgaatcagagcagcaggtgtctgttacggtattggggaaggttaaatcaccgactgcattgctgatgtggctcttgcttgtgcccatcagcttcccagtccccagaacccccagagtcctagactctcatcattctattcctcaggacaacataaatattatcaggagcactgtgagcacagtcctgcttctgctacttaaagttgaagggaaacgagtatccttacatctctgtatcccatgttcccctgtcttcatgaataagtggtttgattgttttgaggccaacttgagtttatagagcttgtctaataaaaagatggatgtccttggggaaaaaaagctgaggctaataaggtgagagagaaacggaatcctttcaatgagctaagaaattacttcaattgaaaagcctgggaagtgaccctatcttggtcaacatatttcatgggcaaggtctggggatgtctggtgtcttcccaacccatgaaggcacccatcccacctgggtttgccctttctagatggtggcccatctcaaggatatttttctttctttctctgatccaaatccaaggactatgttctagtccttcagaaatctatactaacaaactggataagtgattctgcctcaaagttgcataactacagaatcattggtcaagttcttactgcctgctcacttattcatcaggaacttattgtgtacctgccatgtatcaggtactctactaggtgtgggggttacaaagatgaatgtagtgcagtccctgaactgaagaacatagtctcatcatggatgaaagtactccactaacataagatacattattattgtctaacatatgtgatgttattatgggtatggtacaagatacagtggaaacagagatgagaaagctgatcttttacttggagtggttggctaagaattctcatttcagtatggctttaaagaattcaagatacggctgggtgtggtggctcacacctgtaatcccagcactttgtgaggctgaggcaggacgatagggataaattgtttctataaaaaaagtaaaaatgttaggtgggcgtggtggcacacgcctgtagtcccagctactcaggaggctaaggtgggaggatcacttgagcctcggaggttgaagctgcagtgagctgtgatcacgtgagacaaactgataccctatctcaaaaaccaaccaaccagaaaaaccccaagaattcaaggtgggagatgcagaaaaggtaatagtatcctttgcagacagagacacaaaagcatggacacgcgaatgatactgtgcaggaatagtcaggactcatagtcagctgatatgttttagtaaggctccaccagtgcttatacaggtgttcattctgagtagcctgtgcctcggtagtagctaataatgttgaacatcactctaggagtaatcacagattgcctgaaaccataggggttatacatgagggaaagaaggaagaagaaaaagtgggatgaaaggagaccagttatgaaggcacttgaataccaactaaggagctgtgtgtcaccaaattgtagttactgactcattcatttatttatacattccctggaggcagggataccagatagaagactagattaagaatccaatcaagaacaaacaattaattgagctaaggcagtattaattgaaatggaaaggaggattcagataagaaagatatttttaagaggtcagtgttctgactctggtgactgtctatggtaaaagcaagaaacagagaaatgaaatagaatctaaggtttccatattgggtaacagtgtgtcttgtatgtgctcagtaagggttgttgaattgaacacaatgttaagagcggttttctaatgcttttctccaaagttgaaattacagcagaatttcaggttctaaggcatgagagagagagagagagagagagagagagagagagagagagagagagactgaggatctgatgaatctcttggtgttcaacgtgttggcacagtaagcatttcccaccaataaatgatctgtatagtgattgtgataaactgagtttttgaaggatactctatggaggaaccatggttaatgtctcaatttgagaagagaaggacctgcagataagtgtgaatggctgtgtagactgaactgtacattttggcttgccctagccatgagaaagatatatcagatttaaatagacaaggtttttgttacctacatagactataaaagcgttctgcttttttagtagcacactatccaaaataatactaattacccaaaagtggggaaaaaagacaactgtaataagctcagagtatagttaaaaaccaaaatgattattgtgatgttcaaggaacatgaagtctaagtcaaatttgaaagcttctgttgtgagttgatttgtagacttttatggcaaattttggattcattgtatcatgttttgtgactgagtttgatctattcaatggcttgacaggtcctttagtaaagaagacctgtatctcaatgagccattactgaagttgtaatgagtagataggcaatgtcttgatgttcatacagctctgctcaagtggtctgtaattccttgcaatgccgcgaagaaagcactgggctaagagttacaggatcagccctccatttgccagccacatatctgtaaacaaatccctgaacctctttacacctcagatgccttgtttgtaaaatgggaataataacagctgattcggtataacccaaagggctgttgtgaagatcagaagagatactccatgtgcaatttctttgtgacatataaagctctgctgacttgtgatgctattactattgagaaggccacataggtggaatggttaaaggacctatggaagaccactacgtatgatgttaaggacagtaataggctgggacagtgaaatgtggtagtgccctctcttttttctggctgcatgggtaagctgagactgcaggatgtcactgtcttgagttgttgctccgtgctacatctgaatatattacagtagtaacgtactttcagagagctgacaaaattgtagtcagagatgatctttttgaagcaaaggactcttagtcttttattgtggatttatgtagctcaagggatatagttaagaaccaaaataaccattcctggatcttaagagacaaaggattcatagcagcagttgtttttgctgcacttgtgtttatctccttaaatgtgcacgaatatgtatatgttttttacagcatggggaaactcatgttaaaattcattgaaaccattaattggaagcagatatacttctattacatgttttgataatctgtatttacaaacaatttgtattatttttctattcttttttgttatctacctacctgaaggcgagtttcctattatttctagttcaggcttataagaatgactaatatatgaggggaacttctaaacagtctattactctgcagcccatttggataaagaagtgtgggaagatttgagaataagttccctattgtcatcaacacatgttgaccactgacccttctttcttttccaggcaacttaaagtggtcttaatttgtataaaattatatatcaattttgtccctaaaaggtgtggatcaggctgctaatctgattttgtgggtgtgaggagagggaagcatatatagcctatgatgtatgaatacatgtgatgtgcacatatgtacagcagatccatatccctgaaacattttaggagaactccttaaatgaccatattctacttgtgcagctgtggcagtaatgataactttggtttaatatggattattggaaatggaaatgcaataaatggaaactagtgtatatcaatatagaaatgcctattcattttcattaaaagagtattcagataacattttcataaatgttagaccaatgtgtcatgtggaggcagttattaaaaagactgaaggcaaggggagttgtttaactttaaaaaagacttgatatttgtaagtcaaatttatatttccatcccagatttactctgcaactcaggtttggagctgtgaagtcaaaacccaactattacatgcccagccacaaatcagcatgtcatggagagttgttgtgtgtgtttttgtggaaataagtgggagaagttaactgctgttgaattgttggaaattattggttaaatttgagttatatttgcaaatacacaagtatcaattgtgcaaagtgacgttaaagatgaaaaagattttttaaaaatcacactaactatgcccttgatggaagttacctttcagagctgcttcacttacattctctaaaggtttcctgttgctttctattcgttattcttaatttaaaatcaaattgtgccattgagaatcaagaatgtatcaagagcatttacaaaatgtttcagactacaatgtaaaaaagtaagaatgactaaatcttgaagctcacacttgtcaatttaggatagtctataaattcaaattcaagtaaatttaacttttattttatttacttttaattatgaagcagatagcatctcagttttctcacctattaggtccagggtgagaggagagagttacaagttatctattagcatggttcttatgaaagtaatatcagatatggtggcatgtctaaaagcactttgtaactataaagaacagtgtgagcaatgtttgtatttattattattattatttttgacacagagatttgcttttgttgcccaggctggagtggagtggcactatcttggcccactgcaacctctgcctcccgggttcaagtgattctcctgcttcagcctcctgaatagctgggattacaggcgcccaccaccatgcctggctaattttttgtatttttagtagagatggggtttcacaatcttggccaggctggtctcaaactcctgacctcaagtgatgcacccaccttggtctcccaaagggtgatattattattatagtaaatatcacattgaacaatttttatctaaaactaatgtcagaatgtccatttcttgatataaaaataaaaaagtttgcttttcatttttatctttctgtagagatgttgctttctcattgacacagaaatcaagactgttcagatgatgttaataaaacagcacatcaatataatttttgaaggagatttataaaaatgtacattttaattgtcattaaatcttaatacttattgagcaccaaggatgtgatgagaagtagcctgctaggtctaatgacactacttagctgtttgaataactaaatagcacatttctatttagagaccatataagtattataggtattcttggtgatgttataaagttcttcaaagaaaatatgtatttatatctggctttatatattggggcaaaaatagcaataacactttcaaaatagtgacggaaaaacgagtcacaataaatacgttggattctgaagataaaggagtatataattctcagagttacaacatctgtctataaaaatagtgcaattgggatatactattttagtaagaaactcattaagtgtaattttaaaagctgctgcttttttcttaagtttgacattccagtaaactcttaggaaaatgtccttccagttgcttttcctctaagtgtctagaagtggaagtacattaaaattaaaagcagaaagtcccttaaattccttttaagaagtccatcctgttagtctgactcctagaaaggctatggttgctattactttgggctggaacaagattacaaaagacctcaagaagaagtggaaattatcatgggagttttctgtcactcttatagtttatggcctttttgttctttttttagtccattaaacatttctttttgccaagaggtcctatctgtaaaaggaagtctttgataatgatagtttaaaatgctatgtaatgagatacttatatgcaaaaatccaaaaaagcttttttatttctataataatgataatagcaaacaaattatagtgaacagtaaacaataagctaattataattatgtgaattgctttctccctcactgattccttctatacctattattttatttctctgttcacaatattcctgtgctataagggagactgctaaatttgctcttttttagatgaagacttagagacctgtaaggttgatatgactgcctcaaagacacatggtcgcgctgtggctgagtcgacactcaaggccagttctctgtgtttctttttcagtgtgacttgatatagcttgtatcttaaacactgcatttttcttatgttctaggtttctcctctgccaacccctcctggaccattgtcagcagttgaacgacaaaggctgtgaatctgcatcctagtcttagcagtccctctgattctcatgatgagctcacctgcacagcctggtcagtctggttgcttcttaaactgttaatagacttcatgtgaaagatgttgctttgtgttgtttcaaaccaagtaatttaatttatgaaggaacttttttttttttggacaaagattgcttaatgtaacaaattttgaattttgcattcgatagctaattctctattgcttaacccagtttgcttcctggacaactgatttgatttgcattgtagtctgagcatgggactttaattcttctgcttccaaggtaacattcagattgaactttatgaagttatgaatatgaactattatataggaatccatttttcacctgtaatctttctgtcctaacatgtgtctgtatgcttttaaattatactgtggggctttggaagtcagtttgtggattgactccacctccatctctttgacacacaggaaggatatttttcctccccacccttctttgctgccattcctgtttcctatatacatatttaattataatctcagcacctgcttcctcctattccagtgatgtgtgctgctcatgtagtgctgtgatcagcacagccaacacccgttcctccaggaacaggctgtcatttttggagcaaacacaatccaagttttgggaatgatgaagtagggtcagataccacatactagtaacagacaagttttacaagaattttctgcttggatacttacagaagcatttatttctttatagattccttagcatattgatatccttggtttattgaactaagttgaagcttatgtactatcatactcagggcttataagggagacaacttgccaagattttcattccctggattgccacacccaagttagctgtttgggaattccgctgtttcatcaacctttccccacatccccaacaggcctccaacttgtatgctgaatttggaacttgattctaaatggtgcagtccagaaatccctgagtctttagtcacaaccatgtttgataattggcatgtcactaggttaggcagatggcagttacttacttatgcctgttagctctgagtctttattgcctagtggttctcaaactttagcatgcattgacatcactcggagagtttgttaaaacaagccctattctcatagtttttgatttcgtaagtctagagtggggcacaggaattgtgatttttacaagttcccttgacaatgctgttgctgcttggggaccacactttgggaatcactggtttagcttcttctgcccatttctcaccccatcccctaccagcctctacagacaaccttgtttaagtgtgttctgtgagcggcattgcttattacaattatagtctagtactattattctttctgttgggatgaacttaaattaacatttaccttatataggtgtatattgcattttaaatattatgtatatttatttgtatataaattcagtgtttcaaaattggattgtttaaaagaggcattaatttagaaccactgtggtcaagtatttttttcttgtgataatatttggcagtggatgttggtctaccctgctccccaagaatgttgattttataaaatgaaaatctcacttgaagctgctattttgatgaggaaattcttgcgagttgtgataattgttcagttatgaggagagaaaaggtgatggataaataagacaaccattgaatgaagctcacttgactttagggtcaccaaaatttcctcgtgtacttttttcttataaatcattctgctgtgttgacaataacattatgcagaagtctcaatcaactccatttgggaagtttttatgaatgaaatctgaagttgaggaaagtgatagtaaatgtgccaggtgggtaggagtttcttctatttattgcaagtaaaaaaccatgatcagagacctgaaattcactttgcatggataaaggaaaatgttcctgccacaaacataaaaaaaaattttctcctgttattagcctgcatcttagggtgccgtatatattctgagaaataacctgattgtttgatttagaaaaaaatatgtttttcttacatcttttttccccactatctaaaaagagaattaaattggtcttatgcaatcatcatccatttattttgcttttgttccacaaatggctctaaggagttattgtgcaccagaaagaaaaatagactcacttcagtagttccagaaattctttaatagtccatgtttcagactgagtatgtttgtcttcaaaattggttctggtatagtgtgaattcttatttttcccatacattaacatcattcttagaaacgttctccatccatattcaaatatggttgatatgaaatacaaaatgccgccgtcttaatcatgcattcagtcaaacaataagtgctgatttttgtatataaaatttactagtttttattttaattttgctgcccagttctgttcaaagttagagccttgggtattgcttttgggcactgaggatcctgaatggaggaaagactatctggataagattggcagctagctgctgcagttgagctcttcattcaaaacttattaagcatctaacttgtgccagccagtgtgttacccaatagggacacaacaagcactaaaacatagtttctatccttagggacagcaccctttcatgggagagacaaatagtaatagctttagtccatttagtgtcttaagtattttaataaatttaggaccagaaatttatttcctctgtacagcagtatggatactatttctagtaatgtaatttttatcagaattgccaaatctcagaaggaaggattttaggacttatctagcattttcaaaacatgtcagatagtaaaaatctcctgagacttgttaaaaatacagatttccagactcctccctgaaagagtatcgtgtggtagcctgggggaaggatactggattgtagaatgtatattgctctttgctatgacttggcaaagtgtagaaatgctcttagtccattcaacagcactagtgtttcatatttggagactataaacacaaaaacacatcataaagtcttatctcaagtaaatgtttctcttgtgagcaaaactatgctaattcagttattttgttctctgatgatagataaataaaaagctaacactggctaggtgcagtggctcatgcctgtaatcccagcagtttgagaggcctaggtgggaagattgcttgagccccggggttcgagactagcctgggcaatatggtgagatcctatctctacaaaaaattttttaaaaaattgcttggcatggtggtgcatgcctgtagtccctgctacttaggaagctgaggtgggaggattgctcgagcccaggaggtcaaggctgcagtgagtgagccatgatgaagccactgcactgcattctagcctgggccacagagcaagaccctgtctcaaaaaaaaaaaaaaagaaagaaagaaagctaacacagtggaaacctagagaaggcaataatttgaggggaacattctagtggctttgcgtctatctaggccatctcatttttatggggaggtggatggaccaaagagatttttatggagtgcctttattttcctcaaaagaagtttaagcatattttaacccagggcagctttttagtccgatctcaagattatagaaaacctaatttcagcctgaacgtttttaaataaattgggctacatcaaccctaacatgatttttaaatttgatgaatctattttttgtaattaattttgatgaaaacgcatccaaaggaattttccaagcatagaacacaatgtgcctgttgcccttagaattgtgcaatgctctggccttgtgggcttctaggtaaagtggccaaagctgtgttgcaaagtcctgtaacattagttttcaaagccccttgtataaagctagctcatctctcttttcaccattgtgggaagtactctactcatatgaagtgagaggaccaagctatttatagaagtgaaaggtttatagcaagatcttatattctgttcattttctcgtattctattcattttcttattggcaagtcttgggcaaaaattaattaagagatttatcttcatgcctctgttttgctaaacagctgaattcccccatagaaatgtagagtacatgtaactaatgatcaaaaagttctttgaaatataaattgttatggaaatgctaagtagtataaacaatttgggggcaagcattaataaaagcttctctgcaagcatttttaaagaggactaataaaagcttcatggttcaattaatacagcacaacatcaggttttttagaagcatatgggacccagaaggcctgcccctgtttttaaaatttacgaactctttaatgattcaccatttttactccagtgcattacccacagtggtgccatttagccattaagtaggaaactaaaaccaggacaaagctacaaacaaatatcataatgtccaagtgggtattttttcttcagtttgttcatagtgtgttaccaaaaaaatgaatgttaaatgaaacagagtcttagggcaaatcaaataggttatggcttccctagatgagtatgatcagttagctttttaatgaaatacaggtcaaatcccatgacaagtagctctacataactaaaatattttcaggccactggccaattatctatttcaagtaatattcaagaaaattattccaggataataaaacaaattagttttttgatgtttgttgtagcagaagttgatcacagggtatggtattaatgggaaacactgtatgttaaagttattaactattgttttggatttttttttttttttactactttaacttcacagttaagtgattcattcttttgccatttgtaagtcaaaacttctcaatctgatattcaagtttgaaacataaaccaaatgaagcattttattcattctctagtttttgaaggacagtgctttaataagtgaggcataaaccttttctgaaaatgttcagtataaatttgttttgaacatttatttgtttttatatttgcttttcacaattaattttggtgggtaattcaacttatataattttcattattgtaacactacaaacaaactccataatgcaggccaaacagaaaaggttatttctcgttcatataaagactgagtagagagctgctgtttttctaatggctaccctttgccccggacagcttctaactggtttgtgcttcttcagttcatgtattctaaggtcattgtgcatctccgcatcaagctggtgggagggaaattgaagaggtgcattgagtgtgagaggtttccaaaggtacatcacttttgttcacatttcgttgagtggaatttagccacgtggccatacctaactacaaaggaggctgggaaaagtagtctagcagtactccaggaagaggaggagacaggtttggtgaacagctggcctctctctaccacatttgtcttaaaattttatacctaggactgcagatacggtattgcttaccaagaggtgcagtattttataatgcactcttgatttaaccagtcattaaaaagttaagtaattttcctttgaagagattgaaacacattaaaatcagggcagatcagctcaccaacatttctaagagttgcctaagcctttgtttatgaatcatgcagaatagataatgcccagtgtagctattagaaaattcaagttcctgttagtgggaactctgcagaaaatgggagtaaaatgtatgctgaatattatatgtccttaattagtgtttaaaaataatgtcaatttatctgaaattataattgcacatatgctgaggaaaaagtactttaaactttataatcacaattcttatgtttgttctttattgcattttggggtcacgtttttcaacacctctgtagttttaagtattatgatgaaaatctaggccaaatatacagtggttgataaatacttgttttacactgatcttttcatgaacactactataaaacaatgctagactatatattttcttaagccctgtaagcaaaatcttgctacctctgcaaatacacatgtacagccctttgtttataacattatgtggaacctttatggaggatttttttgtctgtatagattggagtttactcttcagagtacaaaaactctgtgtgtgtgtctgtgtgtgtgtgtgtacgtgtgtggtgcatgtgtgcttgtgttgcagtactataataactctagggaaacacaaaggtatgtggaaccatgtaacctgtacttttacactaaatatcccccaaggctttactttctgtggttttctgcatatttcttaatttttgtcatattttgagaatgtcaacgtatagcagttttctccatttataattcactgcctctaacttgttgtagggttagaaagctaagaattgtgttaaataaaattgttaaaagatcacaagttctgaggaggtgcaaatgtcttgtttttttttttttttttttgtgtgtgtgtgtgtgtgtgtgtgtgtgtgcgcgcatgtgtctctgtgtgtgtgttttaaatagagttttgttcttgttgcccaggctggagtgcaatggcatgatcttggctcactgcaacctccgcctcttgggttcaagcaattcttctgcctcagtctcccaagtaactgggattacaggcatgtggcaccatgcctggcaaattttttgtatttagtagagatggggtttcaccatgttgctcaggctggttttgaactcctgacctcaggtgatccacccacctcggcctcccaaagtgctgggattacaggtatgtgccactgcacccagcctgcaaaagtattttttatgaacaaaatagaagtacttgtttttcttacatactgtaattgcattttaattgtctccttatccactgcacccctcttattttctcggttcttctgtctttagtctatagatttacagaattttgagtttccagcgggtgaggcatcgttatggttttaattttgccatacttttccttgcagttatgatacatcagtttttttttctttttttttaaattatactttaagttgtagggtacatgtgcacaacgtacatgtttgttaacataggtatacatgtgccacgttggtttgctgcacccattaactcatcatttacattagatatttctcctaatgctatccctccccctgtcccccaccgcacgacaggccccggtgtgtgatgttccccgccctatgtccaagtgttcttattgttcagttcccacctatgagtgagaacatgtggtgtttggttttctgtccttgtgatagtttgctgagaatgatggtttccagctgtatccatatccatgcaaaggacatgaactcatcctttttatggctgcatagtattccatggtgtatatttgccacattttcttaatccagtctatcattgatggacatttagattggttccaagtctttgctattgcgaatagtgccgcaataaacatacatgtgcatgtgtctttatagcagcatgatttataatcctttgggtatatactcagtaatgggattgctgggtcaaatggtacttctagttctagatccttgaggaattgccacactgtcttccacaatggttgaactagtttgcactcccaccaacagtgtaaaagtgttcctatttctccacatcctctccagcatttgttgtttcctgactctttaatgattgccattctaactggtgtgagatggtatctcattgtggttttgatttgcatttctctgatgaccagtgatgatgagcattttttcgtgtgtctattggcttcataaaagtcttcttttgagaagtgtctgttcatatcctttgcacactttttgatgggctgggttgttttttttcttgtaaatgtgtttaaattctttgtagatttgtcagacggatagattgcaaattttctcccattctgtaggttgcctgttcactctgataatagtttcttttgctgtgcagaagctcttcagtttaatgagatcccatttgtctattttggcttttgttgttgttgctttcggtgttttagtcatgaagtccttgcccatgcctatgtcctgaatggtattgcctaggttttcttctagggttttttttatggttttaggtctaacatttaagtctttaatccatcttgaattaatttttatataaggtgtaaggaagggatccagtttcagctttctacatatggctagccagttttcccagcaccatttattaaacagggtatcctttcccatttcttgtttttgtcagatttgtcaaagatcagatggttgtagatgtgtggtgttatttctgaagcatctgttctgttccattgttctatatctctgttttggtaccagaaccatgctgttttggttactgttggcttgtagtatagtttgaagtcaggtagcgtgatgcctccagctttgttcttttggcttaggattgtcttggcaatgcgggctcttttttggttccatacgaactttaaagtagtttcttccaattctgtgaagaaagtcattggtagcttgatggggatggcattgagtgtataaattaccttgggcagtatagctatttccaagatattgattcttcctatccatgagcatggaatattcttccatttgtttgtatcctcttttatttcattgagcagtggtttgtagttctccttgaagaggtcctcacatcccttgtaagttgcattcctaggtattttattctctttgaagcaattgtgaatgggagttcactcatgacttgactctctgtttgtctgttattggtgtataggaatgctggtgatttttgcccattgattttgtatcctgagactttgctgaagttgcttatcagcttaaggagattttgggctgagatgatggggttttctaaatatacaatcatgtcatctgcaaacagggacaatttgacttcctcttttcctaattgaataccctttatttctttctcttgcctgattgcgctggccagaacttccaacagtatgttgaataggagtggtgagagagggcatccctgtcttgtgccagttttcaaagggaatgcttccagtttttgcccattcagtatgatattggctgtgggtttgtcataaataggccttattattttgagatatgttccatcgatacctagtttattgagaatttttagcatgaagggctgttgaattttgtctaaggccttttctgcatctattgagataatcatttaatttttgtcattggttctgtttatgtgatggattatgtttattgatttccgtatgttgaaccagccttgcatcccagggatgaagccaacttgttcgtggtggataagcattttgatgtgctgctggatttggtttgccagtattttgttgaggacttttgcatcgatgttcatcagggatattggtctaaaattctctttttgttgcgtctctgacaggctttggtatcaggatgatgctggccttataaaatgagttagggaggattccttgtttttctattgatgggaatagtttcagaaggaatggtaccagttcctctttgtacttctggtagaattcggctgtgaattcgtctggttctggactttttttggttggtaggctgttaattattgcttcaatttcagagcctgttattggtctattcagaggttcaacttcttccttgtttagtcttgggagggtgtatgtgtctaggaatttatccatttcttttagattttctagtttatttgcatagcggtttttatagtattctattctctgatggtagtttgtatttccgtgggatcggtggtgatatccccttaatcatttttgattgcgtctatttgattcttctctctttccttctttattagtcttgctagcagtctaccaattttgttgatcttttcaaaaaaccagctcctggattcattgatttttttgaagggttttttatgtctctatctccttcagttctgctctgatcttagttatttcttgccttctgctaccttttcaatttgtttgctcttgcttctctagttcgtttaactgtgatgttacggtgttgattttagatctttcttgctttcttttgtgggcatttagtgttataaatttccctctacacactgctttaaatgtgtcccagagattctggtacattgtgtctttgttctcactggtttcaaagaacatctttatttctgccttcattttgttatttacccagtagtcattcaggagcaggttgttcagtttccctgtagttgtgcagttttgagtgagtttcttaatcctgagttctaatttgattgcactgtggtctgagagacagtttgttataatttctcttcttttacatttgctgaggagtgctttacttccaactgtgtggtcagttttggagtaagtgcgatgtggtgttgagaagaatgtatattctgttgatttggggtggagagttctctagctgtctattaggtctgcttggtgcagagctgagttcaagtcctggatatccttgttaactttctgtctcgttgatctgtctaatattaacagtggggtgttaaagtctcccattattattgtgagggagtccaagtctctttgtaggtctctaaggacttgctttatgaatctgggtgctcctctattgggtgcatttatatttagtatggttagctcttcttgttgaattgatccctttaccattatgtaatggcctgctttgtctcttttgatctttgttggtttaaagtctgttttatcagagactaggattgcaacccctgttttctttttgctttccatttgcttggtagatcttcctccatccctttattttgagcctatgtgtgtctctgcacgtcagatgggtctcctgaatacatcacactgatgggtcttgactctttatccaatttgccagtgtgtgtcttttaattggggcatttagcccatttacatttaaggttaatattgttatgtgtgtatttgatcctgtcattatgatgttagctggttattttgccagttagttgatgcagtttcttcctagcattgacggtctttacaatttggcatgtttttgcagtggctggtaccggtttttcctttccgtgtttagtgcttccttcaggagctcttgtaaggtaggccaggtggtgacagaatctctcagcatttgcttgtctgtaaaggattttatttctccttcacttagtttggctggatatgaaattctgggttgaaaattcttttctttaagaatgttgaattttggcccccactctcttctggcttgtagggtttctgtagagagatcagctgttagtctgatgggcttcccttcgtgagtgatctgacctttctttctggctgcccttaacagtttttccttcgtttcaaccttggtgaatctgacaattatgtgtcttgggtttgctcttctcgaggaggagtatctttgtgatgttctccgtatttcctgaatttgaatgttggcctgtcttgttagtttggggaagttctcctcgataatatcctgaagagtgttttccaactcatttccattctccccatcactttcaggtacaccaatcagatgtagatttggtcttttcgcatagtcccatatttcttggaggctttgtttgtttctttttactctttttttctgtaaatttgtcttgttgctttatttcattaatttgatcttcaatcactgataccttttcttccacttgatcgaatcggctattgaagcttgtgcatgcgtcatgtagttctcattccatggttttcagctccatcaggtcatttaaggtcttctctacactgtttattctagtgagccatttgtctaatcttttttcatggtttttagcttccttgcgatgggttcgaacatcctcctttagcttggagaagtttgttattactgaccttctgaagcctgcttctgtcagctcatcaaagtcattctccgtccagctttgttccattgctggcgaggagctgcgatcctttggaggagaagaggtgctctggattttagaattttcaacttttctgctctggtttctccctatctttgtggttttatctacctttggtctttgatgttggtgacctacagatgggattttggtgtagatgtcctttctgttgatgttgatgctattcctttctgtttgttagttttccttctaacaatcaggaccctcagctgcaggtctgttggaggttgctggaggtcctctccagacgccgtttgcctgggtatcaccagtggaggctgcagaacagcaaatattgctgcctgatccttcctctggaaacttcatcccagatgggcacctgcctgtatgaggtgtcattctgcccctgctgggagatgtctcccagttaggctacatggcggccagggacccacttgaggaggcagtctgtccgttctccaatctcaaacaccatgctgggagaactactgctctcttcaggcctgtcagaaggggacgtttaagtctgcagaagtttctattgctttttgttcagctataccctgcccctagaggtggagtctacagaggcagcgggccttgctgagctgtggtgggctccacctaattctagcttcctgagcactttgtttatctactcaagcgtcagcagtggcggacacccctcccccctgccaggctgctgccttgcaggtccatctcagattgccacgctagcagtgagcaaggttctgtgggtgtgggacctgccaagccaggagtgggatataatcttttggtgtgccatttgctaagactattggaaaaacgcagtatttggttgggtggtgtcccgtttttccaggtaccatctgtcatggcttcccttggctaggaaagggaattccccaactccttgcacttcccaggtgaggtgatgccctgccctgcttcagctcaccctccatgggctgtaccctctgtccaaccagtcccagtgaggtgaaccaggcatctcagttggaaatgcagaaatctcctgtcttctgtgttgatcacgatgggagctgcagactggagctgttcctatttggccatcttggaacggaccagtccatagttttataatgcatgcctatgtgttgatttgtgttgctttggagttgctttaatatccaaatgaaagactcatgaccatattattggtgaacttttaaaaaatattgtattgatttataggaaattgataagctttgaggtaatctgtaaaattatttttaacccccccccccctttttttagaataacttcctggcacttgattatataaggctcttgctgcttatgatagatggttgctcctcacatatcattgcataattaaccttttctcccaggctcttaatgtccaagaaaatgttctcttcataccagtaatgtagttccactggaaagtgttctgggtgagctggggatttttcctttggagctggaatttgccctagtaattctgccttctttggaattctgtgagttctgtgagagggcagataatcatagtggtgtatgaccaagcactcaccttttatctttaactctcagaagaaattgtttttcagaaagaaatgtcaaaatgacattattcatgagaaaaactagtcatgagttttggactctctaggaatgtaaacatgtttaataaaagctggtgacagtttttcggtctgctgttactggaaagcctgcttgatttccttccctgtgtttttctggtcttgagatctccagtgctttctgaagatccaggaatgccgtacaaatgggaaaagccagactgttatcttgaacctctgtttttgaaatctctgtctgataaggaaaaaaatattgcaagtcattgtagttacttgtttggtttgtcactggaattccaaatatttgcttggtggttcatggacatgtaaattttgggatatgttactattgtttagggtatactgtctgtaaaataagttattaacccagtgactgttaactagatcttccaaaagccctgtctcctatcattttatgtgtattgaaaaattattataattagagatttttttaaactcttagaaaatgaaagtatacagctatgaaaattctgtttgggtaattttttaaaaaatttattttcagttcagaggtacatgtgcagatttgttatacaggtaaactgtgtgtcacagggctttggtgtacagattatttcatcatgtttggataatttttatgttattttttaatgcatttttatccttttgtctgtattattgtgcttccttttttattaaagaagagttggatgtatcttactttggctttatgtttaaagtgaaacagtaaattgaaagattttaacaggtcgtggtatgtcaatgaaagaacctagaaattagcagaaaaatgcaggaagccaactatagatattggaaaaataatacataccataacttgagttaggtaatgtacactatcgagtctttgaatttcaataaagtatgtcaaagtagacattgtatgtcattttcccttctgttgggagaactgataatccgcctacccatctgccttcctacctttcttagttttctttctttttcttttattctgcctaagtccagaaaagatttggggtctatataagtaagttatggaaaataaaatacgtgaggaggaagggaaatgaagggaaattgggtacaccctgttagtacctgcatttaaattctgtgaagttgcttgaagacggatggatctgtgtctgagcttcctgattagcaagtctgttgtctatggtgcgattaatctcttctcagcctaactctgatatagtcactgccctgtataagaaatgtcagtggctctctatcacatctatttaaggtatataagaacccgtacccttttcaggcttatcttatttttctcctcaatgaaccccactctgttcaacatgtagagctgcttaccttccccaggtccagttttcttgcttggaggcctttgaatgacccttcctcaccactgggagtgtcctgtttacttatcttcaacacccagctcctactccattcttctgtgaggccttcctgggtgacgctgacatttgttacctctctcagttctggaacttaccttagtactggggttgtcttctctaataggcttagctttttgagggcaagggacatctaagtacattttgtggggtgtatatagagtgaagcagttggcagctgtatttatggttgctctcttagttaagtaatatactgcccagcacacaaaaggagccaaataagtgaagaataaagggcactttgtgaggaggctgattatagtggtgctaggggcatggaattggggaggagggaagcagttgaatatacctgagcaaaaccaaactgtttcatatgtgtcatgaatcatatcccttttctttttgcttattcatttgttgactttcggttcttttcacctctagtgctatccactgaacttcctccatccccctacctccccttccctcccgttccctcctccacctcccctcccctcccctctcctctttgacagagtcttgctctgtcacccaggctggagtgcagtggcacaatcttggcttactggaacctccacctccctagttcaagcaattcccttgcctcagcatcccgagtagctgggattacaggcacatgccaccatgctggctaattgttttgtatttttagtagagacagggtttcactatgttggccagacttgtctcgaacttctgacctcaggcaatctgcatgccttgggctcccaaagtgctgggatgacaggcgtgagccactgcacccggcccccctctttctaaggtggcttatctattcattgaacaacaaacattgcaatagggtagtcattgtttgcaagacttgtggtttcatactgagttctctaaatgtggggaagttgctaagtttggctcttcttcagctagcacagcggtagaagcagacctaccaccctctttccttttagtaacttgaacttctccctgtttcaatgcttataaaccacctctctcccaaaacaaatatgtattgtggttaagaatagtggaaagagtgacatgatttttaattgtggttgagcaggaaattgttttaagttagtttagaattcattgatccaacattctttatacttttaaaaagtaatacagttttgcatactgtataattagcagtaacttttaaatatactacgtttctgaggaccttcagtaaaatacatagaaaggaaaacatccggcttaaaatttgtgacttttcaatctgtatacattttcagttcctcttatttaaagtgatagactaataaatattttaatataatggttgaagtctttattaagattaaattaggatcttaaactttctgtgtgtctccattaaagatgtgtttttggcttcattatttgacagtgttgtggtatggcatttaatggagaacaagatctcttactttggaatgtatctggtcaaatggagttcctttcatatttgcccaggaagcttatttttctaaagattatggaaataacagatgtggaacaagcaagcactgcatgtctttcattcagagttctctgaggaaccaccttgggtaggcttttgtttgtcacacacatagcaagtatgtctttaccctgactgatgcaatagtccagcctcctgtggggtatcatccactaacaataatgccataacccattagttgattgcaaactctctgaatccatagggacttgccccagtccaaatgagtgactaattcttaaactacaaggtaaagctgaggtcctaagggaggagggacatgttaaggtttgactgtttattttgcttgttattactgcaggatcattaaagaaatgtttatatcctgttggggttctatgttcttaaccactatataaggatgaataagctttgttttttttgcttctacctctcttatatttctttccattctctaccctccctctcctaaggaaaaatggtgttcacactcattgggtctaaataaacccaaacgtcttttctttgaatattttattaccttatctgtttatctattaatgagaaattatacaaatgcatatttgaagttcttagtaaaagcccaaggacttaaacgcagctctggaaacacctgtcatctatcttttatttagtaaatctccctttgtcccagattcctcatttggaaaatatgtcatgaatttgttatgttggtatcataaaagatgtaattgtacaagagatagtaaagtatcacatgttcatttagaatgatcacacataaatatgtgcttttttctctcaaccgtgacctgtaactatccttttttgaatgtcacaaaaatctcatgtctataagcctctccacactgatgagattgaggcctaaaaccatcatctcccagctctgtcacaatttccagatttgtctctgtctttaggtttgctcacttttgagcacatagaattatgccatccttttcaaattacatgtcagctccttactttatcctacccccagtagtgagcgccttagttgccttgcttcatcttttgatgtgtttttacactgtttgtcatgccagcatttcttgtgagcaccctccccaagacacatacacacacacacacacacacacacacacacacacacacacacacacaccacattcttaacctatggacatttgctgctgtaaattcattatatatggtgcattgaaaatgtttgctctgtgtttctttctggaccttgtgctagcaactttgttttgtcatttttgtcaagtgattttcttttttcttttttttttccaaatcagctaagtcactgataagattgatgagtatgagagattgatcattttacaatttccatcctgcggccatatgagaggttgtatttggtacctagattagatcaaagagtgtcagaactcaatgggctgtataacatgtggcaggtagcagagtaaattggaaagaataagaataccagaaggagccaagaaatacctgttggaaaccccaatctgccctaactaactttgggcctttgagaacaagttactttatctctctggatatcagttttctatcttgtattagtttcctgtggctgctgtaacaaattaccacaaacttggtggcctaaaacaaaggaaatgtattttctcacagttccagaagccagaagtccaaaatcagtttcactgggctgaaatgaaggtgtcagtaggaccttgctccccacaaagactccaggggacaatctgtttcttatctcttctagcatctggtggctgctggcattctttggtttgtgactgtatcactccagtctttgcctttggggtcacattgccttcttttgcgtgtgtgtcaaatctcctcctccttcactcttatatgcatatgtgtgattgtattttgggaccacctggataatctgagataatctccccatctcagaacctttaagcatgtctgggaagtccttttttttccctaagaggtaacattcacaagttctagggataaggatgtgggtatcttttgggaggttgttattcagctactaaacgcctgaaataatatctgaagtcatgctggcttggcttgtaattgctattcatttcattcatttgttcattcaccaaacttttatttcatgcctaatatgtgccagacactgttctaggcaataggaataacccactgatcatgcctttagtaaattcattatattgttggtgagattaccatacagaataaatgctaaaataaaggtaaaagagacaatttagactattggattaattctttgtatgtctccttttgcacagttctggagcacaagccaccagcatgcctcagtacttgtaaatcatttcagtaactacaaggattatgtgtagtgtagcctgtggaccagaaagtattttacagaggtcaaagcacgcatcagcttaaattcaattcaggtgtatatattgagtacaaaaataaagtttagacctccaccacaattatacaatttttgtcaaccctggctgcacatcagcatcaatagcaggcctttacaaactactcatacctgtccccctaccccaccttgtgcttggttctaggtggagcccaggggtcctttaaaaaaatcttattagcagattcttacatgctgagggcattgaacagagagaacctgtggtctgaagaataggaaaaccaaatacaagggtactgatacaaatgcaagtcaaaatactgtaagttttctcaggatatatagaaacaaaatagtttggatactcagaggaaaatgagatcacatctggctcaagggaaatttgaagacggaagtgtttgaaatatccttgatggatgtgtaaaatttcaacaggcattgattaggggagggtggaggaaagggaatccacagaggtctggagtaggggaaaaggtgtgtgtcatggctggcagcagggcccaggagccaagatctaggcaccaattctctctccttttgctgagactttctggcctggaaacttgaagagcttgagaattctaaatttaaatctggtcctctaggtcattgtgaaggtatattttttcaaggcaggagggtaaaatgtattttatttgacaggtaataggttgatatatactttttaaaaatttagaaacatgatttctgggcttccatttgtactcttgctctatgtcgtacaagtattaggagcaggcttctgtgggggaaataaaaatggagaggaatgttttaaagtgtttcaaaagaagaatagccaatatgtgatgactgacgggaaaacagacaaacatagtgggaggtaacaaaggtaatttaaaagttcaagaatgacagtagaattagtgggagtgagacatattgatggaaaagatagctagcatttgttgagtttttctcacaagccaggggctttcactgcattttctttatgtcaatgaattattttcataagccttgaggtaggtactattcttatcccattttacagacgggaaattgagactttgaggggttagttatcttgctctatcaaggtcttacagtaaatctagctcttggatccaggtaccttaattccagagtttgtattgttaaccacagttctgctagttgtcaggagattggcttgagaataaggctgatgaagagtagttgaattcaaagacaggaatttaagaatcatcagaagagaggtcacagtcaaaaacttgggtagtcagcaagcatcaccttatcaattaaaaaacggaagaaagagagaagagtagagggacaagactaaatgtcactgaagctttcagggcagtatcttatacctgtttatggctgccagtcacttaacatatgattttttttttttttttgagacggagtctcactctgttgcccgtgctggagtgcagtggcgcaatctcggctcactgcaagctccgcctcctgggttcacgccattctcctgcctcagcttcccgagtagctgggactacaggtgcctgccaccacacccggctaattttttgtatttttagtagagacggggtttcaccgtgttagccaggatggtcttgatcttctgacctcgtgatccgcccgcctcggcctcccaaagtgctgggattacaggcgtgagccacggcgcccagccatggtttgtttttttaaaaaaagcccttgaatatttaagtaagcaaatgaaccaatccctcaatcgtgaatttttctacctgtgcttcagattctacatacataataattacgatggctagaaggagacaaatctaaagaatttcctcaacttttgctgcctgtttttgtgaccctgattcagtttcaaatccttggggatcttccttggattccattttttcaccttactccatcttttcccccacagaagatagctgcttttggaaggttatcctagcataagaagattggcagaacacttcactacttttgtcattttaaacagtttctttaatttaaatttttcatttttctgtagagatgggggtctcgctatgttgcctaggctgatctcaaaatcttggcctcaagagatcctcctgctttggcctcccaaagtgttgtgattacagacatgggccatcacacctggccattttaaacagtttgtaaactaaggtattaaagtaacaatacataaatggtaaagtatcctgggctgttgagtgtctttctcctcccctcctcttcgagtgccctgaaacttttttcattctaccattctcacaatgagtatgcataaaaagtcactattaaataatccaggaaaataaaactattgcctttaaaatatataaattatacatttttttgttacctgttattgcatgttgagtattcctcatctgacatgcttgggaccagaagtttttagattttgtatttgtttggattttggaatatttgcatataaataatgagctattggccgggcgcggcagctcatgcctgtaatcctagcactttgggaggctgaggcaggcagatcacctgaggttgggtgttcgagacccgcctgaccaacatggagaaaccccgtctctactaaaaatacgaagttagctgagcgttgcggcacatgcctgtaattccagctctacttgggaggctgaggcaggagaattgcttgaacccaggagggtgaggttgcggtgagccaagatctctccatagcactccagcatgggcaacaagagtgaaactccatctcaaataaataaaaaaataaataatgagctatcttggggatgagacccaagtctaaacatgaaattaatttatgtttcatacataccatatgcaaatagcctgaaggtaattttattcaatattttaaataattttgtgcacgaaacaaaatttgtatacctgaggtaaggtgaggaatttccacgtgtggcatcatgttggtgttcaaaaagtttcagattttggaatattttggatttcagattttcaaaataggtatattcaacttatattaaccagatcaaatgttctatgcttgtcttgttctcttgaccctcggattatttcacaatcagaatccagcatattcatttgaaaggtgtagggtattgaataaaaaggatttcagaacagctatatagttgtgtcagatattttaatattatagtactgtatttttgtgctattgtatcagagtcacatttttattaaaatttatgatttacacctaatctcttaaaaaatactgcagagcttgccttagtctgtatcctgcatgtcctatttctttttctagtactgtaattgagttgctatgtaaaatgtggtctgcctatgtaattcttcccacctaactttattaggaaaattaatagaatagcaatatcacaaaagtgtttgattagaatcatgggaaatgaaactaatttgcaataaagcccaagactggctttcaaagcaagtgatttttatggttagaagtcaaacaactttacttacagacagtgatcgaggcaaaaaaagtccatttgttatttgaaagacatcaggaaagccactgattctcagtttggactatacattaaaataacctggagaactaaaaatgaaaaccaaaagtctgaaccaggaccaccacctcaatgatactgacttaatttgacttttatgaggcttaggcgtgagtattcgttaaacctccaaggtaattataatgtgcaactaatgttgaggactgctattaaagcaagcatcaggaaagcacaaagaacaggataaagtaaataaatataaaatccttaccatttaggagatgacatgtcctttctaaaagaggaaatattgtctattaagttatgaaaactaaacttttagttctattttgaaaagagacaaattaatctcatttaaatattgttacaagcatagataagagtacatatctatactttttaaaaagccccttttttttctctttgtatttaaactcacttatcttcttatattcaagattattaaatctcagctatgggcctcgttttcccctaccttcatattgttccaacttatgaattgaaactgtacattaatttccaaatgaataatttaaaatcaatggagtaaatgggacacttgcagtcaatgaaaaaatccagcgattatctcgggcattttttttctccataaagaaagcatgattactcttacaaaatggtattttgtcacttcgtgcaaagtatcttgatcattctgggcctatgttgctttttctgtaaaactgggatatcacatattgctgaattgcagtgaccatttattgagtgttcattgtatttcaggttctaagtgtattaagtactttatatgtgatatctcattttatcagattgaaaacactatggagtaaggactattttctaaaatcctattttgaagatggaaaaccaagccttagagacttgcctagctaggttaacatgtctaaagttatatttcttgttatcgactgggccaggatctgaatttaggcagtccaacacggtagccactggtaacaaggtagcgctaaccctctgtgaagacaaatttttctgtttagctgactggttaagactaaaattaaagcttgtaccttctttacagggacgttttccaaaaagacagtcttgatatttcccaactgagcaacaggtttttctgttgaagctaacaaggaacaggtgcactgctggtgttggcatgtgccgctggcaccggacttgtggtaggatggtgctttctggtgctggttgggttttaaggaaggagcatgacactcaaaaattcccaaagcccataagactctgccccactcttcactaccaaatcttagggaaaacttcgggtagggagaaaatagaagagagctcttctggattaacatgaagtggcttgaggaatgtcaggagtgggaagccaggaaaatttgtggtcagaagaccttaattaaattcctggctctgctcttcatgccctgaaagtcactcaacttttctgaatctcagttttctcaactttaaaatagaaatgatgatgtggtaattgaattccatacttcaaaggacagatgatcaaataagataatgtactgtaaaaactctaaataaagcataaggtggttttgaaaactgttaatgttaataaaagcagatttttattttctaattggaagtctttatctctttaacatgcagaataaaagtaaaacaatatttactctacagaactacttaaattagaatgcctgtgtggtatacttggactgacttttacttccccaaagtgttcaaaacccctaggcatttaagcaactttcagtgtattagttactgcctaatgggcaaaccctatgatcttttctcagtcttcatagaattatagcagtaataatttattattcaataagtgtacattgagtacctactatgtccctggaatgggtttaagtcattggaaataacagtcagtgaaaataaaggcgggcaaaaatgaaattgtctattaagcacctaatgtggacaaagtgttacatataatctcattgaatcttcacagcaatcctgtgacataggttttactggcattacttataaatgaggatactgagggtcagagagtttaagaggcatgtctggcacatcctagcaaggagaaaagtagaactgggattaaaaccctattctatcttcttttctagcaagtggcttttcttgtgaccatttatttgttaattcatttattcatacttcactcagtagtcgtttgactttcttctttctatgaacatcacagatattttcttagccacctgtggttaaaaccatggcaccatctttaaaactcttaactctattcccctccacatcaaatctgttccaatcttgacaaaccttgtcttccatttttgttgccaaccttttgcacttattactccttgctgctactattctactagacttagaactagtctactttccctctcccctccattcagcctaatccatacagtgttgcctagtgaatcttactaaagcacaaatctaattatgtaatttctcgaaaatcttccatggcttgccatggcctacagaaattgtcagtaatcacaaggcattcctactgtcaagggtatagggcaaaccatattttcagccttcttcagtgtgcttcttcctgtgcacaaaattcatgtttcccaggcttgtctgataagaatcacctggggctaaaataattcatagattcagtggtattcccatcaaaataccattgacattcttcacagaattagaaaaaactattttaaatttcatatggaatcaaagaagaccctgtgcagccaagacaatcttaagcaaaaagaacaaagctggaggcatcatgctacctgatttcaaactatactacaagtctacagtaaccaaaacagcatggtactggtaccaagacagacatatagaccaatggagcagaacagaggcctcagaaatagcaccacacatctacaaccatctgatctttgacaaaactgacaaaaacaagcaatgaggaaaggatttcctgttaaataaatggcgttgggaaaactggctagctatatgcagaaaattgaaactggaccccttccttacaccttatacaaaaattaattcaagatggattaaagacttaaatgtaaaacctcacaccataaaaaccctagaagaaaacctaggcagtttcattcaggacgtaggcatgagcaaagacttcatgacaaaaacgccaaaagcaattgcaacaaaagccaaaattgacaaatgggatctaattaaactaaagagcttctgcacagcaaaagaaactatcagagtgaacaggcaacttacagaatgggagaaaatttttgcaatctacccatctgacaaaggtctaatatccagaatttacagggaacttaaacatatttacaagaaaaagacaaccctatcaaaaagtgggcaaaggatatgaacagacgcttctcaaaagaagacgtttacatagccagcgaacatgtgaaaaaatctcaacatcactgatcatcagagaaatgcaaatcaaaaccacaatgagatactatctcatgccagttagaatggcgattattaaaaagtcaggaaacaataagatgctggcgaggctttggagaaataggaatgcttttacactgttggtggggatgaaaattagttcaaccattgtggaagacagtatggcaattcctcaaggatctagaatcagaaataccatttgacccagcaatcccattactgggtatatgcccaaaggaatataaatcattctgctataaagacaaatgtacatgtatgtttattgcagcactatttacaatagcaaagacatggaaccaacccaaatgcccatcaatgatagactggctaaagaaaatgtggtacatatacaccatggaatactgtgcatccataaaaaggaatgagatcatgtcctttgcagggacacggatgaagctggaagccatcatcctcagcaaactaacacaggaacagaaaaccaaacaccgcatgttctcactcgtaagcaggagttgaacattgagaacacatcacacagagaggggaacaacacactccagggcctgttgaggggtggggggtgaggggagggaatttagaggacaggtcaataggtgcagcaaaccaccatggcacatatatacctatgtgacaaacctgcacattctgtacatgtatcctgtttttgtttgtttgtttgtttgttttagaagaaataaagaaaaaaaagaatcacgtggggcttattagtatgtgagttcccagaccccacttgaccatactgagccagaatctgcaaggatttacagagccttgtggggcatggtaagactggtgttcctcccaaagacccagaacacaggtgcatgcctgtgattatcctaggtctcttgctagcactgtgtgttgaggtagtcagccagtgtcatctgatgtgatgacactttgtcatatctgagacctcccagtcaccctttctcacgcattactgaggtgcaaaccaagtgtcaaaaaacccaaagacacattaattaaattgaatcctccaaagaagtgtttttctcacatttttaagagcatgagatatttttatgtgagcacaatgtgaaacacataaaaagatttaacttgtaaataacttgtgtgtggtgtgtgtgtgtgtgtgtgtgtgtgtgtgtacgtttgagacagagttttgctcttgttgcccaggctggagtacagtggcacgatctcagctcactgcaacctctgcctcccgggttcaagcaattcttctgcctcaacctcccaactagctgggattacaggtgcctgccaccatgcctggcaaattattttttgtatttttagtagagatggggtttcaccatgttggccaggctggtctcaaaactcctgacctcagttgtcccaccaatcttaccctcgcaaagtgctgggattacaggcgtgagccaccacgcccggccataaataacttgtttagctcatatgtgattgtccaattttgggcatgtatacatagatacatatacatatataaatgtatataaataaatatgtgtatatgtgtacataaatgattatgggcatatgtatttgtgtgtttgaatatatgtgcttagggatagggacacacatgtacatgcatagatgacttgccttcgccaaaatttatacagatgtttctcaacttacaatggggctatatcctgataaacccattataagtcaaaaaattgtaattataaactggcttataaaaagaccacccaatattgcaagataaaaggcattaactgtaagattatgatgcaagaggaaaataatgaccagaaaataagttggagtggaaaacgtttctctaaaactttctacgctatcattgaaatagctattaaataatatattgaaataaagattgttgcttttctctttttattttcccaattttcactcttattaagtaaaattactcagcttttaaaatcacttgtatcatctcactgtgtatttacagattttttgcttctcagaaatttctgtatgtcccaaattccttttaaatatttaaatattatgcatgttttacctttgtaaactcctacctttgtaaaacatgcggaatattatttatctcatggatttcacccactgtcaaaagtctacttccctatcaccaataaatacttgaatactattaagtgataattttttagaatcacagggatcaaactatagttgacttttgaacaacacagggattaagggtgctatcaccacccccagtggaaaattcatgtgtaactttttgactccctgagaacttaaccattaataccctactgttgactggaagccttactgataacataaaccattgattaacacattattttatgttgtatgtattatatactgtattcttacaataaagtaagctatacaaaaaaattaagaaaatcataaggaaggaaagatatattgccatttattagctgtgtgggtgaagaaaagttacttaacttgactacgctcagtttattcattaaataatctttgcagacctggtaagcactggatgaaataatgtaataagacaaaaatgtgaagattttctccatagtcttatcactctgtatcataatttaatcatgtttctttacacggtttctcaattcctgagagaatgattttagacaaacccagagaactctctttgaatatcattctttgtttcaaatgtatttccttgtggcaggaaacgataaacacacatggcacagacagctagtgactgaaggggaagttaatggtgtttgtttttcctccagaattagtagttcagaaattaaaaataaaaatgtggcttgccaagtttgtaaactacacagaattctttgattacaagatgacaatgaatttaatttttttgacatttgtatttctttgatacttatgaattgaaatgttttgaaaacttatgaatttgcagctttacattttataaactataatgattaaaatatccaaatccattaatttcttccttgccctgtaaacttgaaaactgagaaaagatttagagtaaagcattttgaaatcattgacaagcacaaatactgttagattctatgtcaagattgtattgctgcccttgaggagacattatacgtgctttctaagctatgacgagaagacataaacaaggtctttccccagctatgtgctagaaaaaaacccttaattgtgattgtacagtattgcttgatgcaaaagtcaactcatttttcaccagggattcctgtccattcctggaaatgaggtaggatgaacccggccggggggcgggggggtgtcacagtagaaggtggtggtttaggaaaatctacaagtgacggtaaatactattctagaaagttaatttttttttatttcagggagcaaatcctttatatttggcaggtagaatgcaacttcttggtagtgtctttcatttaattaaaattaagattgatgtggcttgctgctgctgcgtaatatcattctgacttttgcatagctattgcatttgtaaatattcaaatgcactttgttatggataaaagggagttccttgggtagatgtttaacttttattgcaaaacctcttgtgctcacttacgttgccagatttggtagtagtcatgcaccctgggaaaatcactggcaaagcagtggagtggaaaggaatcatgggtatttactgtgaggagaagggaaggtaaaggtgttgtaggggttatatcatttcactcaggaatttgcttttggaaatgtcattaaggatatagtatttggggatggtaggtatttttagaatgtttctaagtaaaatcacgatttttcttttaatgcactgtgaagaaatcatctagtccagtgctcatgaaatcaatttagtaggttgcaattcaacaatggaatagaataggctaaaatacaacatgccagaatgcacacacgttgtaacatttagtgttaatttatgagactgcatgagttttatatagataagcatgtttctatatatatgtgcattgtatttaatatgtatttctcagtatgagtagctgttgaaaaagcttaaaagccactgattgactttttctcccattttacagatgaggaaactgaaagaggctgattctcattttatttgagtgggtctccttgaggcagcttatctgtcatcaggggtctcttgttataatctgtttaattacctatgcatcttttacaatttttcacccttgctcaaaaattgctatatttttgtgaccagaaattggatcaaagatgctgattctggggagataatctttgctgagtctctgagcaccatgttggatgggtagttggtgcttgtaataccaaggggaaaagaacagaatatttatagctctctgtagaggtaagatcttaggtaaagtcagatgaaaaggtggaacaataatctaatacatttcatcaatagatacaacaaatcaccattagcttctaccatttgtttcagttcagttcaacaaatatttattgagctcctacttagtatcaggtattttaaaagctagccacttacttccttctttatgataaattaattagtcaaacaattaaattattctctccctttgcttgtggtgtacagggagatttactgaagtaaaagggggtttcgtttgtcaaagatgaaagagatgtagcgccatgctatataacacaatatgctacttggaaatctgttatgccttatctagaaatgttcctaatatcttgaactccacctttcactcattaggaagtcctgcaatataaagctcacctataatattttctctatatttgctctcataacacattgatttatattgaactttctccttgttgctatttatacagtgtcagttctgctctatgagctgattttttttttctctgactacctgagaattgaggcagcagggccaagggggccgacttgccacgtgaggttttgtctttcccaccttgttaggctgcttctttgcctttctgcctggcaattcctgaaggtggtgttctgttttatctcttttttgtttttaaagtgtttgtgcaaagcatattattctgtttttactttgcttcttaattgagtatcggccatgtaacttattgtttgaagcagttacagcatcagggaatagtcccaaatggcacgatgagcctgatttttcctgatggctgtcactgtggaaagggacacccatgaggtcggtccaagccaaagaaaggagatgtataagtacagcctaatcttattagtgggtctagaaaaactgcttctttattaactgtcagtcttttaaatctttgctaattataacgattaaacatgatattttgtagtcatttctacttgcattcttgattattagtagttttgagcttttttacatatctctgtaggattttcttcccatgtttggaatttctgtttgtgtcctttggttatttttcttttagactattctgttttgttattgatttataagaccttttttctatcctattgaaattaatcattttcattgtggttaaattttatcattttaacatattttgagtgtgcactttagtggcattaagtacattcacaccatttgccaccctcaccgttgtcccatctccagaaatttcccgttatcccaaactgaaaaaaaccatggtaggtgctatgaaaataggcccaagggcctcttcgattcttaacaagagagatgctaaccccttttttcccacaacactagtaacacttcttgaatcatctaatcccctaattatttctctggatccagtgctgccatgatgattgcaacttcattttaaagatgtattcatacattaaataaacaggcaaacagctgttctcatatgaccatcttattgagcaaattctgttttgtttagtctttatagttcttccacttgttatttaatctactggtgtttgatgttttccttgcttgccaatgtggtatttccagctgtgcatggaaattaattttctatttgaatagacaattccaggaaattatctattaaggttataggaggcaaagagaatgttgctttatagttttgtgtgtgtgtgtgtgtgtgtgtggtgttcttggcattataaggaggaaaggttggtttaagagttcatgattgccagtttttgtttttaactaatattacttaaataaaacaaactctgccactggtcacaaacgctgtcaataataggaagtatggggaactgaaaacttattctctatctgaaacaacaattctaaatggattgctcatggactctgaaaccttttttggacaatagacctctttgtgtatctgacagattctgtggaacctcaaaacctaaggttcccatatttttatctaaaaccctagttgagatgcattttggagtcaagaatttatcagattttaaaaaggtagtatgatttaaaaaatgtattgggttttcaaaagtaccatatacccccatattacctatcacctttaatggggtctgggatggttccctataatcaaaaaatagtatttctgcagttaaattcatagatcttaatcttaaatgagataaataaaaacatgaaatagcctcacatctgtgtaggtcagtttatgctgccagataagttgaggtttgttgccaaacaatttctgaaaaatcttttgttctttaggatcagtgataagggacaaacacaatttcacctatactctagggggttccactgttcttggtcaggagtgttttggctccatgcttcagccgggcctgcttctcctcagccctactcaagtcatggacttagcattttcactgttacagacatttttgcttctggagttctgcacctgtcacttttttgatgaatttaatcctcttttttgcagccatatcgtatatgggctctcattctttatactcaatatgtttgccgttatgtataaatgtttcatcataacgtgaacacatatattatgttcatcatcatccctattcctttgtattggttaaaaaattggttattctcaatacttgaaatgccttttttctgtcttcctcctgttaatttatcctctaccccatcattgtaccaggataaccgattttctccttcttttatattctctatattcttttaaagctttgtgtctaccactgttttagcatgcattacattcctccataattatttgaatatttatccatctcttatataagactgcacatttcttgagagtaatacctctttatatatccattgccttgcacagtgcctggcacatacagattcaaagcttttcagcccaagataaatagaaggtgtacatttggagccagtggggtaagattggagacatgagaaagagggatgtacaatcttaataaattagagttcaagacagaatagtgtagaggaacagtgattttgtttagtttatgtgcacatgaggattaggaaattaaatgatatatatggtttggagaatggagaaatttcaaaaaggaggtaaagcttcagacaaacctgggcaaatggatgagattgggatggaataggcaaagaagaatgtacagtgctttcagagaagggagtatgttgaggagcgaattggcattggtggctgaacaagatatttaagctattgccaaactataatggaagttctgaattatgagatgatggaagaaaaaggtcagtaggccaaatggtgctggattatgtaaagcaatatataataagaaaaagaattcgatctattcagagtaaggtgtcattataagttaaggagtagaacagggatggtaagataaaaaacatttctgaaaataaatgtgtccacagcgtacgcagtgatgcctgaactaaaaagggtgtaggggtgtggggctgagttgttttacatcataaggacctgaaccgagaagacagtaatgagactggagaaaagggtgtgaaacttttgaaaagtaaaaccatagtgtgatagttaatttcttgtgtcaactggagtgggctacaggttgcccagatacttggtcaaacactacttagggtgatactgtgagggtgattttagatgaggctgacatttaaatcagtagactgagtagagcagattgccccctttaatggggatgggcctcatgcaattggttgaaggcctgagtagagcaaaaggctgaccccccttatgtaagagagaattctcttgcctgacagtctttaaactgggacattgaccattactggttctgcagtagccttctggcttctgactcaaaactgggaaatcagctctgcagcttttggacttgccagaccccttaatcatgtgagccaattccttataatcagtctccctttctttctctctttctctggagaaccctgactaatacgcgtagtatatggagactgactagatatgggagccacaggagttgagaaaggaattaacaattacttaggaatgggaatggagaaattgaaaagggcagtcaattttgatggaaaatatatttggttttgattttgttgactctgaagtgatattggagattcaagttaaattactgtaagcagctgtagtgaggtaggtagcttgtgtgggtgaggctggatgttgcatctttgaatcatctacaagtagggcaaaagaagttacgtgacagaacagagttcacaggtgaatgagagagacaagcataggcaaggatttgactgaggttcttcaggtgggaattatggggctagaggagaaagatgagccagtgtataaaaatattggtggcagagctctcttgacattggtttgtcagcctcttgcaccagaatgtaagctccatgaggccaacaatttactcagtcctttttccctagctttaagtgttgtacttcagatatttgagatttgtagacattgttttttcttcattttccacttgagacaaagccttttaaggaaaactgaaccaggaattaggatttatttgctgtaatcttgactttgcacttagatatagagactgaggtttgactttttaattcctaggattttgactcctttttcaaaaaatgaggagattggattaagaatttgtaggattccttacaactcaaaagttatggagaaaaatatctataggctgaaaattgttctaagctgcaaaaatggccttgagtaacttcagaaaataaacattaaagcaaatcatcttttatatcccttttttgaatgttttatttatttaatatcaatcaaaatactgtaatagattaaataaatcaaaacacatataatcttgtctagaagcagctttggactaaaaattttcttcgcaaaatattaaaggtgtgacttttaaagaaaatctcttaatacaggacctaaccccattttatatagcattaagttaatataactgtaaaaaagaaaaaaatataagcagcatttttcttttaatatcaacaccatagagaaattttggttcttatggaaattttattctattacaaatcttccaactgtaaaatcttctcttagagttgattatgtaattgaaaacaaagggaagaatcagtggctcaaatggtcctgtgtttaccatacttcattcaaaattctcttgcatctcctcatatgtttctagatatgttaacatcatacaatctcacaatatccatttttaatttatgcaagaatactttctgttttgaatagcacattattctaggttatatccaatgtcagttttgggtatttgatcaatatgtgatggttaaattatagatggctaactttttttcctaattgtacaatttgaaatatggtgaatttccaaaaaatagtttggagaaaatatgaactctattttaaaaatgtgcatgtatgttgatatcatgtatttgacatagaaactgtcaaacagaaatagatgtcataaactttaattcaaaggcattagactactagcactaacaaccaacattttttttttatcaaatagaacttattttgcccccaggatcatgcgttgttttagatattaattaacattataattgtcttctcactttctggtatgcaggggtactctccatgaccaatctttgtcatttatcacctatagtgtaaaatttccatcaggaaacaatcttctgccttgaactaccaaagtgctgattttgctttttgtcattaagttttttgtttgtttgtttgtttgttttaatttgctttagagcttctttattgaggacaactaacagttaagagttttcttggggaatagtgtcacagcaagaatcacacatagacttttcagatacaattcttctatctccaaagtaatgctagaaatattgttgatttacaatagatataatttaaaattatttatttttattttccacagatcccaatttctggatttcttgtgaagtttaataatttatccttggattcattttatttttgtttatatttatatagaaggcatttagccattcatgttgatcagctgacctcttagttccatttgtataatgtaatatctggttatataaacccaaggatctgctgttattgtttgctctgcaatctgatagataagagattaaaatagggtgggtgtagtggctcatgcctgtaatcctaatgctttggtaggccaaggcagaaggattgtttgaggccaggagtttgcgaccagcctgggcaacatagtgcgacctgtctttacaagacataaaaaaattagttgggcgtggtggcatgctgaagtcccaacactctgggaggctgaggcaggagggctgcttgaggtcatggtttcaagaccagcctggacaacatagtgaagtcatgtgtctaccaaaaaaaaaaaaaaaaaaaaaaaaaggctgtgcttagtgttgcacatctgtagtcctaccacgcaggaggctgagatgggagcgaggattgctggagcccaggaatttgaggctgcagtgagctatgatcacaccactgccctccagcttgggggacagagtaagaccttgtctctgaaacaaaaaacagagagagaaaaaaaataataagatgtatgtattcagaaacataaaaaagcaagagtaaaacttttgtgacaactttgttccatttataagtcacactaatgactgatttgcttcttagtaattttccatttgtaacattttgtacctggatacacaaatgtaatgcaattgaacaagaaaacaattatctgtctgctggaaataatgtacttatctcattgaaacaattgacttgtttaaaaatacacaggtctgttcagactgcagttacctgtaatttgtaatgaatttccaggaagaattaaaatcctctgatgtaattgaatcagtagttgaaaacactgattgtgaatgataaatttccatgcataattcccctcttatataaacctccatttggagccattttagatttgagaggttttttcaatattctatgagttttggctggatccctggaaaacttcactcaaaggctgtatcttccagtgaaagcttcatgttgacttgtgggttctgtgtcagtggaacgtttcagtactttttggcctggctcaaatgtttcttggcattttctgtggagtttggcccaaccaatctatagtatcacattggactccagataaaccctaaaagccgtaattcatccgcaagctaatatgggactttattggggtttggtagtagactaacaccatcgagcaattgggagttcaacattatgaatgatatttctaaggacatatctatctgaaaaatcatacaaagagaagctacttttcctttagcccagcacttatttttctcagaggtctctttcacagaggtcaatgtcctattttaattcgttattataattttttccctcctcagcagtttctaaacctattgcagatcaacagctttttcttctttcttaaagtgagatggctctggctcttggctgacttcagtcttgtgatgtgggactgatgtgcgttttcatttttcactttgaaggtgctgccaaagctagttaattttagttataccatcatagaatgctggagcctgtaggtgccctagaaatggtttggtacagcctcctcgttttacacataaggggagccaggcccagttccttagttctcacaggaagctacggcactgttaggatggaactcgtgtccgcctcgcaacagaacgggtctctgcaagtctatccggctgctgaaagatccactccccattcccagtctcagattttgtacctctgggtagttttcctcttttccttaaagctttttaaatgtagctccccatatgttatattaatttgggaaaccagccaacaaattagttttacatttgttaggattctagggtgttatttatgataccattctctttgtgttctgagtcactaagaaataaatataggaacaagacagagatcaaaataatagcttcattataaacagtgttaaattttagaacacatagtggacccaaggtggaagccagcttcttatgcctttaacagtcccctactgagcttagccactcagtcatagagaagtgtgcaactgcaggttcctggtccagccctcatctgcagggcccaccctcagggaggactagctgagcagcacctctgagagactccaggaaccaagggcctcctgccaagggaagggcctctttctcaagtctggccaagtagagcagtccatacccactcatggaaagcagtgtccttcaatggctcaccttctggtgagtgtttctctttccttcttttctcttgctttagcattcctgtttcacactggtattctgaaaccaatattagtatatttcttttccttgtaagatgagttattttcccattattctcctgaatagagttgaaaaagcaaaggtagcaaaatcagcctaggcaactgattatttacaatagagaaaaataaatgaagaattaagtagccggtaatgagagatggcaccatgggaacgtgctcagaatacttcccagtaatggaagatgaataatttttcctgttctctcctgaccaggccattgttctcacatttttaagaagagaaagttgggaaagacttttacctctctgtttacatctttgtttaagctctagacctctgccagcacccaccattgtattttgataaatatattctcagccatctataggtggattcacatgatcttgttttgctttcattttcctgtgattttgaattaagtaaaatttcagatcacagaactctcttggaaattttagttgattcatgtaggtaggtttctataggtttcactatttcattttgttccagatatttttccaatgtttatctctttttttaaatcttctacattagctttcaagatacttacttatgagagcccagataatatttaagttttcttcatattaagggatttttttttccttcagatttcttgccttgtggtgcatgttgcacagacacttgtacttaattcagaggtaaatgaaaagtaatttacaattctaatactcttgatactcatactttctcctttactgtttttatgcttgcaggtttcacttccttttagtaggttgagggccatttagataaaaaagatacagaattgcagactagtagatttaagagtttatgtattatgatttaagttgttaagatttaaggtgttccagtagcatacttggagttgaaatcatgattattaagatgaattctttttgcgtgagcagcttaacagacttctcttgaatcaccataatgtttttgcttcatgggcatgtcaagtatctgttatagtggaacctgagagaggtcatacaggaaatagcatagaagttgtcacagtacacctggaatgatgctcaagtggttgccatgggctcaggagccatttgcctgggttgaaactcagctcttcattcctttgtttcagtttgctcatctgcacaatgggcatactaattaagatatctacctcgaaagttcttgtgaggattaaatggatgaatatatgtaaagcagtttaaacgagtgtctgaacattatatatgctttataaatgtgagctgttaaaacagtccccacgtgcctaattgggtgaatagatcagggttcctctgtgttttcaagtgtttctctcagtacactattatttaggaaaaatagactaaaaagatattgtctgaggtgttactggctgatattttaaaaggtgaaccatgcattaaaagattgtgagtctaaattttgtgtaatttaatattaataaataacctgacttctttgatggtctacgtgaaatatgaggatttcaggcactttgtttccacagccaaaccgtgtatgttgtcttcattactggcaccgattttggcattttgatttttaaattattttgtgcagttttcacagttgctcccattagaggggaagtattgaggaagtagtcttccagttattgacagatcttaagaagcataaaatggtttggtattttggagaaatgtaggataatataagacccagaggcatactattccaagtagaaaatttcatcatataatgcatttatatgtatgtggtatatgtgggtaggcaaattccatcatgaaaggaataatgaaggaacagttttggggcaacctaaagttttactttagtttgtataataattaactcagctgcataaatgccaggaaaataattagaacaacagattatgttgaatgcctaaaaaaatgtgtttaacaacttttaattttctttcctcccacacaccacttcctagtttgtttctggcacaccagttgtgtctcaacacagcggctgatctggtagagttgtgtgaacacctgtgattgtggcagaacaaattttctccttctggttacatttatcgaaagtaaaagtagaaggagcactgtattttggaggtaatgtagagatataggggatagcctaccttttctccaaagctatgtatgagctttcaatgttttgaaagctcatgcatactgaagcgtgtgtccacatggtgaatgtaaacaaacaaaagctgattgtaaccatcttgcttttcctagttagatatcaatgggctactattggtcagagaaacaaagagggacctccattagtggggaaaggtaaaaaaaatttagtgacagtgaaagttttaaaaataatatatattttttctgtttaagatattccattatatttatgacgttatgagattccttcaggagtggttgtttgataatctgtagtttacttaatcattcctatggtgttacagacagatttataaagttttgctattacaaattatggcaccacaaatacctatttgaatctgccttttttttttttttttttggaattatttactcagtttaaaatttctggcctgatgttattaggttaaaggctttgcatatctttgtaagtcaaaggatgtagattttaacaaatggcttttcaagtgctttgccaaattgctttctaatataaatatataaattgttaacaataatgtatgggtttttcagtttcactttttgagaccctgaacagtgatcgttgttgcttttttaaaataattttttgtatttattcaataaatataaagtggaacttcagtgttgtttcagtttgcattgctttggtaaataaaatgcgtgtgtgttctttttttcttcatgtgtctttaataatttaatttcctgttgtgcatgttcatgtttttgaggtatttttcttcttgattttctgtttttctgtcagattgtttatcccctgtatgtaacatacaaatcaacattttatcttatgtttgataaacatatttctgcaatatgttgtttttttattttaccatgactattacttttcttagtgttaaagctcaaactgttgtaaaagttatattattttgtttcttttattgactctaggtttaaaaagttgtcatctttcaaaaaaatattcaattctattttatgctaatgtttagtgaactaatttatatgtgtgtgtgtgtgtttataaacccacggatacatatatgcacaaatacacatagggagttagagacattagtattataatgatagtatatggcatacattttgatccatttttttcctcaaattactagccagttatgtcagcctcattgattacatagctttctgtcttctcctccccagttgttttaaatttcccctttatcatattattacattctaacatataattagatattttactgggctttatttttttattcactgatctatttcaaattagatataaaaatatttttaaaatttaattcttcaaattattaatgcttgataatatgctttaaatgtagtaggttcaggtcttcttttccaaaaacattgagcttctcctgtgttacaaactgtgaatatggaaattaaaattatacggtttccccactcatagtaatcaaagtcttgctggaaaaacagacatgtaaaaatgtaattatactataatgctacaaatccagaatggagagatgaacaaagcactgatagcaccgaggtgacagtatatttttacctttttcccctatattttctagttctaatgaaagtttgattatgatctaaattgctaatttattatatctacaaaataacttagaaaaatttgattttttaaaatcctataatcttctccctcagggttattgtctgtttcatctttttaattttctaattaaattctgtagttttccttaatgttaaatactggttagaaacatttcatgttaaacatacgcatcttatggatattatttgtgacagtctacaggtaattcagtgtttgatttatttctttaaagaagcctatattttgggtttaccattcacagggaaaatcggagcccatacttttttatctttctttattgagtgtggggtctcaaacattcattggtaatacctttgggatttggtaagaaatactgcacacagatacaatgtagaaatttcattgagatttttttaatagtaacttttaatagttaaaattttgaatagttgcttttgaaatgaatgataggccaatgaaaaatttgtgtgccatgaaagctatatttttatgaaaacctgattggaattatggaaaacaatctgtgttttatagtcatggaaacctgtgactgatgatcatttttggaatgttaattgtaatttctatcattgcagctgttaattggtaacaaggaggggattaaaggcattaaggagttttggaaaataaaacttaaacacacatcaaatagcaatcatttctggaattctgctcatattagttgtataaacctgactattaaaatatagaataaagtttatttcattattccagtttctaaactgtatattatttaaaaatatgtttgtatttacaaattaggtcaggagtaagcagggcctcagtgacgtaaataaatcccaatggaggcttgtctttggactttctcttttgtgtaattctttgtatatacaagatccttggccaagatcccattatacaaaagaaaaggtggggatgtgggggagggtgaatattcccagagaaattcagcctttcaattacttgattattcttgtggttgcaggaaattaaagaataataagtttgtttcctatgtgaatcataaaaaaataataagggtacacacagggccattgacttaaataaatggatggaccttaaaaaattcactttttggaggggtgcatcatgctttttgaggacacactgaaattttgttggtaatcccagttccaagcctttcaagttagtttaagtgtaggaagaggagtggcagcaactggataataaatttagtacaaatgtttattttatttcatttatgtattgcctcattcaaaaaatgattcgagatatcttttcttttttttttttttttgtcttttgaggcaggttctcacttggttgcccaggctggagtgcaatggtgccatattggctcacagcaacccctgcctcctaggttcaagtgattctccagccccagcctcccaagtagcttgggaattgtttttgtttgtttgtttggtttgtttttgtttttgtttttgtttgagatgagtttttgccatgttgcccagggtggtctcgaactcctgaactcaaagcaatctgcctgccttggcctcccagtgtgctgggattacaggcatgagccactgcaactggccctgatttgaaatatcttataagaacatgttcaacttaataataataaaatgtgtatagaagaaaaggtgcattatctggaaaagtataaataagaagaaagtcctaactggaaacaagaaaataaatattttaggatccatgcaattttgttttgattcattatttttatttatttatttttaataaagataggttctcactctatcatccaggatggagtgtagtggtgcaatcgtagctcacagcagccttgaactcctgggctcaagctgtcctctcacctcatctgcccaaggagtcttttttttttttttttttgatttgagctttctagcagccaaaacaaaaagagtgctgtggcataaaaggatagatatagatgccatgtcttttgccacacacgtgtgcatgcatacacacacacacacttacatactgtctctcataattatttatttattattagatttatttatttattcatttatttttgagaaggagttttgctcttgttgcccaggctggagtgcaatggcgcgatctcggctcaccacaacctccgcctcccgggttcaagcaattctcctgtctcagccttctgagtagctggggttacaggcatgagccaccacgcccggctaattttgtatttttggtagagatggggtttctccatgttggtcaggctggtcttgaactcccgatctcaggtgatctgcctgcctcggcctccgaaagtgctgggattacaggtgtgagccactgtgctcggcctatttatgttatttttaaaaagcaaattgctttcatgttccttaggagtggcacagctatgtggatctctaatttctaaaataaatttctcatacgtatgcttagtagtactttcgtttcaaagaactagcttacctgtgggtgatttcagaccaacctgttcagttcttctgtttgagagacaaattcaaatgcttatagttacccagatgaccacctttcacattttctatctcatcctagctaccacttctcccttaacatcacctgcaacaaacaaaatgactcccctaatctgaagccaattttaatttatgggatggacctagtcatttgtatccaaaatgtctgagagtatcttttttttttttttttttgagacagggtctctctttgtcatccaggctggagtacagtggcatgaacaaggctcaggcagcctccaactaactcctgggctcaagtgattctactacctcaggctccttagtagctaggactacaggttcgcaccaccacacctgactaatttttatattttttgtagagactggctttcgccatgttggccaggctggtctccaactcttggactcaagcaatccacctgcctctgcctccaaaagtgttgtgattacaggcctgagccactgcacccggcctgtaatatattttaaattgtaaacaaagttatcattgataagatatagaaaaaaatttaaaaaaaaattttatctagctgtcaatgagaaggaaagcaagctaaataatgaaaattaaattagcatgaggaaaatgaaaaataaagagagactggaagataccacataattatgtggctcataagtctaagagttttgaaataataattgagtcaggaaaagacttctgccttactcatatgtgcattttttgcatttaatattttattatatacaacttaattgtcccttagttaagtcctaatccactgaataaacaaaagtaattagtcaacataccttgcttagcagctttacctttttcaaattttattttgtttatttattatgtcatttccaaattcctgtgggccttttggtctgtaatctccataaaccactgtaggcatagacattttaatggaaagggctagtgacttttctggttttgtgaccttttacattctgattcaacaaaactttattggtcacccgcttatataacagtcactatgccaagagatttttcataccttatcacatattactttccataataaacccatgaggtaaatactttatggtccccatttaatataggacactgctaataagcctcagggagaaatgagcccagatcacattgctagtaagtgctaaattttggctcaaacccatcttgacgcttgaagccagtgttctttctatagccatatctcttgctaagtacttctgacttttacttaagatatagtcttctctttgattattaattactctggtgtgaactgtgatcttttatgaaatctaagactgctactattatccgggcaaaattgtggaattgaatcattgagatgctgattgaattgttgttgatggttcaacaattttgagatgagacagatcaaattttcctttattgaaatcagagtggttggagcttaataaaaaagcagaacatcttaaggtaaaagagcaggtacttttttctttttttttttgagacagagtctcactctgttgcccaggctggagtgcagtggtgtgatcttggctcactgtaagctccgcctcccagtttcacgccattctcctccctcagccttcagagtagctgggactacgggcgcccgccaccacgcctggctaattttttgtatttttagtagagatggggtttcaccatgttagccaggatggtctcgatctcctgacctcgtgatccgccctccttggcttcccaaagtgttgggattacaggcgtgagccaccgcgcccggccaagagaaggtacttttttttttttttaacactgacattagttctctttttgactgctaaggataactacaaatgatacattctgtaaaccttttgtctgaaataataaagaaagtgaagcacagtaggaattctttaaaatgttgtcttgttcattgggcatttattgggtacctagtataatccagatattctgtggtgttctgtgatacaaccttaaataagacaagacatagatctggctctcaaaatatttatagtctaagggggaaactttgaatttataattagattgttaattttcaaaaattaaaattcaataagttgcttattagcgtcatcggctttggaaatttaacacttttctaatgaagaacataagttccagttaagagggtttcctatttcagacaatgtagaataaatcagcttgttccataacttttaatatttttcaaatataactcgcattttacctttagaactaaagatatgtcgagaagagttcattataatgtaattgagtcacttaccaagcctattttaaaaccagttacttccttttcttactttgcactctgtgacacatagacttccagaatcagagaagtattgtttttgtttttaggcacttgctatattatgtggaaccaaagccaagttaatatggctaagtaattttcagttcaaggtaggatattagatagaaattctcttttctacttctagatttggacatgaagtagcttttcatgttataaaatgacaaattttatttatttgtaatgaaataatcccttttatttatagccaagttcatcattttaacacttaatcttccatgacagtccggaggagaagaaacttggcaaccattcattattatctgtttttatcatcagaaggtatttatttgtagggggagtgtagaaatgatgtcaagggtaggacatttttgtacaggacggcctttcctttggagtcatgatggtaaatatgaccacagttacttaaaatgcatgcaaatagttaccagtcaagatgtataaagttccctggaaactcagaagcatgtgattatagctgtggaatgagaatgcctaataataaaaggagaaaatgtcagttttggattagtgatttaggaatcccatcagtgactatctaatcagcagcatttcacccgttgttttacaaagctcttattgagctgtgcttccatacctttgggcttgtatgaagatctgctcatcatagaagcccacttacctatagtttcaacatgacaaatctgagcttaaacacaaattagaatatttaggccctgaggctatttcttggatttaaatatagcacatagtaggtgaactttgagcttgataatgctgtggtacagtgagagaaggccagtgtcaaggatatctgaattgatttgaccttttgtccttgcatgtgaaaatgacgtgcttctgtagaagtctatatactcatgacttccttctaaaatgattattgtacagtattctatggacatttgatttgattcttctcacaaaattatcgagacatccactagtgtctacttaattgatggcaaacaagaagaaaactgtaatctggagataactaggtaaaccacatattctacatctgtgcctggatagaatgacttttgtggttatgtatgcagcaaacacttttgagtgctggtcatttccctaagctctgagaatgcaaaagtgtgccgtgtccattgtgattattgtggtgaatacagagtgttgtgagagtaaataatgtggagggagtgagaaaagcctcctgtgaggacatttagctgagaaggaagggtaaggaggagacttaagagggcgtcagaagttctggagggaaggggagagtgggagtttgagggacaaatggccgtcatggtggagtgaacgaaggggaaagtcacctgggattaaggataaagagaattcttgagtaactaaaaaattgatttgttcacgttgctcagtgattctctgactgtgtttctttggggagaggcttataaaaattagaatgtccaagtcttcatagctatctaaatgttttctgcatgtttctgtccagcacctatgtctgacttcatcccaatttgatgattaggatgatgataaacaggatgatgaataatacaactatggagatttaaattagaagaaaaaatcttctttatctttttttattgtaagatttattaatacaaatctgtattgttattcagttctagaatgttctaatatgcttcttccatccaaagttatgattacttctttacctcatataatattattacattttcttacaataaaatacatttttaaaattcactattaaccctgtctgtgatgagacagcataatcttgtggttaatattagctcaggctctgtagccagaaaatacgggtgtgaattcttgttgcgtcatcaaagatacagatgtgagtcctggctgtatcattcactgactgtttacatttaatatgttatttagccttcaaaacctttgtttactcatctgtaaaatgggataataattgtaccagcctcctaggataggtaagatgttgcagtgaagtttcttgttacgatgtatttccttgattatttcataagacagaggaggcatcttttctgtgttcctcccttgagatactaaaatggccagggagcaggtaagttccaaagattaggtttcagactgtcatatacaacttgtagtccatctgtgcagctggagactaaaccaaagtgtcacataaaccttttcctaatcaaagtggttgttcatttattaatgtaaatgccctgtgccttggatgtgtgagtcctaaaaatacacttccagggataaaaatagatttctgggagttctgagatgctgcttaatcagaaccagctgcaagctgtctagaaaacgcaagttatatgagccagatggcttttgccctttttgctttagacagcatgtaatttggataactacagctacagtaatacattttgccagtcacagtgtttgataaacatgtttgttgagaacagccacttccaattagagacccagtaaaatgttaatttattttaataaattttccctctagggcaagacaaagaatacttttgacaggttacagaaatatctgttcatggaacagagtactgttcaaaagttattgtatgccagtgattaatttttcaatttggcatttagagaatgatgagcagtattcatgacctccccctccatttttctccttacaacctcatgtatatataagagaccaggatttttcatatttgaaattatgttgctttacgtgtagaaagatggtttagctaatttttaactttcttctacccatgtctaattactataaactctgataatagttactgaattattgcttgcttacagatgcttattaatgtggtagttcttgggatttttcttttatgatcgtattctttgagaagaaattttctctgttagtcttatgtagccatgactgattttcatcagctgaggactgcaaacgtagtcactgatattggctgaattctaattttattcagctcctattcagacaaaatagtaaagctaaatgtgtaagctattcacactgtaagacctaaactcagatacagcctacttttaggagatgtgaaactatcaattcttccattttcactggtggcaccacttcttggaaaagcgtatttaagccctggtttcccattacaggaattgaaatattctgtgctttatttcttgagacatgtctaccaggcatcatgtaacagactgtgaagtacctttgaaggatctcttgagtcataatttttccataattccagtccttccagctttgtaagtttagtaatcacccagcagttgtttttttccttccccagtttaagaggagagggtatttcatttccaggataagtgatattagaacataaacatcattataatagtagctacaggtttatttactcttaccaggaactatgctaatcactttatacattattgcatttaagcctcactacaacatagtattataaggtatatatttttattctgttttgcagataaggatgtcactattaatataacatttttatattaatagagtataattgttctagaattatcactagaatgatgattattcaacatcatacagaaagtattacagccagaatttgaagctactcttgtattaatggtgtgtctggctcaggatctttaattccacccattaagctatgaaaattggcatttgacctaactagggctgctttttcagaggtaaatgcatgcctctggccatcttcatatacttcaaggaatttacagtattgcttcttagcatttattttaagctcagattgtatgtgaaagagtctgatctctctcatcccaccttgttagatgaattataactgatgtgctttaaaaataattcatactgctggggaaaaaatctcactttgatgcttttccagtatatagttaagaattacactgatgggtagtaattgaagaaattggtaagcacttgtgtgatatgaaacagcataggaaacttatatataatatatgatagccattatatataagcttatatataatgtgtataacatttacaaaagcaaaataatacctttatgtttttatttaacaaagtgagataaattcattagtgaatgcagcagggcatacctgcaaattctgtcataggtagcaggaaataaagcaaagcattgtttataaaaagacctctttgttatggttctgtccactcaaagcaaactgatgggggcatggaaaagatcttattacttttgactattttggaagagcatactgttggtattattttcatttgcagctataaaatggtacttcttgaaagataccataaaataatagaacagtttatacttaagtactatggtatgataatgggcttatgctgtttgttagcaaagagttggtgttatttgttgtttcttggaaatgaaagggagaaacagataatattcctttctaataaatggattattctattctaccctattctattagacaattttatatccaaacaattactgaactctatttttcatatttcacagagttgtacgcaagatctagatttgaatatgaaatctgatacctccgtgggccagtcgaaaaaagcattttgatatcattagatgagagacattatagacatattagttctagagaaagtcccggtcctttctttatgtcaagagatttgtgttagaaagagccaacaaggcctatgcactcaattaatatacatcagttttctgttagcatgtaaggtcctatagttggtgttcaagaaaagaacatgatacatgaaaagtgatctttgccaaatgtatccatgtttatgctaatgtgggtaaattgttcctcttttaccatgtgaaggattggtagcttaatagtttgctttgcttaaatgattttatgtggcagtgttgaggatctgcagaagtgactgtgtccttgccctcaaagaacttttggcatttggcaccaaaagggggcactgctctcttgtgacataaaatgtagtccccgaatagtggggcttttgaaggttagtgactccaaaggaaatagtagatgaaaggaaaacgtatttacttcatctcatgggggtctttcttgccttggtcttcctgaagaaaagataagcattgggctgaaaatgtttgttatatacccttgggcaccattggcatattccaagctgtttttgtcaatcatataaatacatatttagacaatttctgaaacatttctcataaagaaagaagtcattcatctggtatatcatattcatatgcatgatggctttctagagttgtgtcatttcttcactatggcttctctcgtctcgcacctcttcagaaggcacccttcctttcttttttcagtaaataccacaattttatttttaggtgtatgcagcatgaaatgtatgtgtgtatgtgtgtgcctgcgtgtctgtgtgtgtgtgtgtgtgtgtgtgagagagagagagagagagacagagagagtttgagagatagaacagagagattgattaattggttgattgattagttggttagttggagcttttcccagaaagttttccaactgttcttattggcatatttgaaagtttaacaaaatctcattaaagttcatggatttcactgaaatctcttatttttattagataatcagtaatattataagtatacataatctgccatcccaatattttcaaattttagttctttttctatcgtattggtaagaatgttacagtttcttcctaatgttggtgataggcatctgtacatctggttttgttggaaacaactctgctaaatgtttaataaggtgctcattgtaagttaaagatagggaatctttattatattatagaactaccctggcctatgcacatgtattgagatgactgcatgttatttagcatgcagggataggttctgttttaacatattttgacctattgatgtcgtaacttcattagtagattacctagtattaaaccattctgggatttctgatgtaaacacaattggacatgttttattattatttaatatgctgttgggtttggaatgtatttcatctagcatttttgcctctatatttgtgatactgaatgatagttttctgttttgtcagctggttttcaggttttagtgtcagggttactaggcccatcacttatgattatacaagttgtacactgccacctataatattgtcatttgcatagttattatgacagttttacaaaggaggacagtaaagtatcttgaggaagggacttttttttaaaaccgtattgacttaccatatcaactagcagaatgtaacattctaaaacagatttttaaaaaattccatatttttccattccttcaatgtttaaaagaatccacgcaaaaaatcagtcaggtttatttgacaatagttgtttacttaaatttcttctagaactgttcatctctttagggtttatatattctactcagctgggatgatcttttaattttattgaactattaaaattcattctttaacaaccaactatacataatattctttataattcttttattcttttctgtgtttttcatcccccttttgttactttactattttatctttttcttgaatattaagatttgccttttgttttcctcttttttccttctccaaatacttttggctttatttactggaatgtaatattttagtatttgaaattaacaactgtttttatctttattattttttcctcttgctttccttagatatagtttgttcacttttttaaaaggtatttgcattgaatatttagctttcttattttctcttattttttattttcaaaggacctttttgggtacttttaaagtttgctaatttactgtaactggaacatttaatatggagttgaaccaactaacataggtgtgctatccatgtgagaatccttcggaaacatttagcttgacaaattgaaacactggaattaatcttaaaaatctgtattaggattgcattgacaatgtctagtgttttaaaatggcagtttattctctgattttaaaagcagtacaagttatccgtggatatttggaaaatatagagaaacatgcttagctatgtaacaattaccctaaaatttaacaacttaaaatgacaaacattaattttctcacacagtttctgagggtcagaaatctgggagaggtttaactgggccatttttgctgtgtctctcctaaagtagtagtcaggctgtgggctggagctgctgttatctgaaggcttgaatggggctggaggacccatttcaaaaatgattcactcacatggctattgactggaggccttagttcctcactggctattggcaaaagatgttggtttttttgccatgtgggccacttcttgctgcagagtgagtgatccaagacagagtaaagtggaagctacaatgtcttttatgaactactttcagaagttacatactggctgggtgcagtgacttgtgcctataattctagcagtttgggaggctgaggtgggcggatcacttgaggccaggagtttgaggccagcctggccaacttggtaaaactccgtctctactaaaaatacaaaaattagccaggcatggtggtacacgcctgtaatcccagttactcagaaggctgaggcataagaaccacttgaacctgggagatggagattgtagtgagctgagatcacatcactgcactccagcctgggagacagggagagactctgtctcaaaataaataaataaataaataaatttaaaaagaagtgacatactgttccttctactgtattccattgaccctactaaccaaccgttatacagtgtgggggataatgacacaagggagtaaatgccagaaggtgcggatcattgggccatcttgaaagctatccaccacacacagaaggacatagaagttacgcttaggtccaccattcagtccctgtggatcttccaggtttttgttttcccttccattgcagcagaccataaacatttcttatattatgaaatagtgttctaaaatgagatttttatatgtttgcttagtatccatttttagggcatgccaatttattttaccagtttcttaacattattttataattgggttgttttgagcatttgactattataaattataatatttcttgtctacaaatccttgagcacatctcctgccatttacctaaaatagattcctagaaatgttactcctgggtcaaggcatgtaaacattttaaggctttttacacataatgtcaaaatattctgcagaaatttgtacccaaatttatactagtattgccataacaaaatgatgcctaacttcttatgtgcttttcaatactaggtacaatattttaaaaatataaagagcctgataaggaatatagtatctcatggcagtttgaattttttattactaataaggtaggggaattattttaagagtcttattcttgaatctatgtagtatttttcttcttgatttttaaaggtatctttatcataattacttttaaagttgtaattagttctctttaaaaaaattatagtttgctttctttcaaaatttatttcactggatgttttcattaaggctatacaatgggagtggttctgtaatgaacctggaagtgttgaaaaataattgaataacttaagcactttcaaaataccaattagtttgttggtgactaaactaagtttctctaacttacattttattgattgaacatttgctagaataatgagttaaaaagtgagaagatgcttttttttttacttttgttgtaagccatctgccaaaatttggtgagtgctgaggaacatttgtcaaggaataaaatcataattgagagttgtctagtctgaaaaaataataaaaacactctcagtgtttccatgtgatagaatgagaatgactgttattacttcgaaagtttcctgcccaggactttcatataactgatgttctctgtgttgtacaaaaaagaaaataaataatagcttgctgaacagttttctggatttccaaaaaactttattttggtttttgatattttcataataattggttttaaatttgaaagttgttaagtaagtttaacagtgagagtggatagaatatgttgtctggcaaggcaggagcagagtgtagcagggagaccttggaataaggcgcttattttatagtcaactctgtttcctgccttgtggctttggtcctttcagcctgttttctcacctatacaaaaggaatacattttgccagatttgccagattattttcaaaactaagttatataatgtacacatagtgcctggcacacacaagtgcatgatacatgtataaagcaacaggaataactatggaaatgtgtactattcttaacataagtagttggaaggggagatcttcacaagaccataacaaaatgaaaaattcagtgatttgtaggtgaacattaaatttatgctataattctgaccaagagtgtatgtgatgggagggaggggaacaaatatttattttttgcaccagtgaagagttttgcaattatcgcattgctataaaagtttgctgaaagattaaaaatagaataatattagccatgactattcagaactgaagaccgtgccaaacaaagcaagcaatagactagcagtatgaactttgaaacccatagatgtgatgaattctgtggaaccagctcttaagtgtatagatacatagatgttcatgatttcactgggggaggctgatgatcataggtcttgaactggaattgaagaatgggttggtttgtacaagagtaagagagaaggagtgtcataagcccaggaatagtatggacacctacacagagacagataaccatgtagtgttttgctgtgaataaattgacctaacctagagaatctgtgtttgggatgcagtatggataggaatggtctgatcagaatactgagaaccttaattgtcaggcaaaagagatgaagcaaactgtagaccatcagttgaaaggttttagagactttaatgtagcagtgatgcagggtctctgtcgtagctcagatgtgggatgcactcttaaagtgagctcagtaagtcaggaagaaagcaatcagattccaaacactggaaccataatttctcacttatttcctactcaagaagcttttagtaatgttatcttgttctcttatgaatatgttgttttaaaaagaagaaattaaaatgtgacatagctgttgctttcctttggttgacctcacttttactttttattttaacactttatttttcaagaaaacacatactttgaaaaatcgtataattataattccacagtgacaatttctataatattttgcatttctattcctttttttttttttgtgacggagtttcactctttttgcccaggctggagtacagtggtgcaatctgggcttactgcaacctcctccgcctcccaggttcaagcgattctcctgcctcaacctccagagtagccgagattacaggggcccgccgccatgcctggctaattgtgtatttttagtagagatggggttttaccatgttgtccaggctggtctcgaactcctgacctcaggtgatccgcccacctcagcctcgcaaagtgctgggattacaggcacgagcccaattgtattcctttcttggaggtgtttcctatgacttatcctggctacagacctgctggaaagggagtagcatttatgaaactcctacattgtattatgcatgttagtctcagcatcccatttagtctttacagtatccttataaagcagatgatgttattcctattttacagatgtgtacactgagcttccagaaaattagatgactggtaagtgttagttcagaatgctctgctttgtaacatgatgcttcctgagagaatctggggaatgcacaacttttggcaggagaaataaggactaaactaagaacagcaatgttaattttttttttatgccttagagatagggaagttagtctccctcagaggaatccaacttgattttttctgagggatataatatctagtcacagggctgttcctttgcttcctgaggaagtgaaattcactaaattgggtagtgaccttccatatttaaagatacagttacagcttgctttagtaaaaatgttaacaaccttggaaaatgcaaaatatctgatctcaagaagattctgatacccttcattaatgaaaaaagaatgtcttgtttcctttctactataatgatcatgaattttccatgtcactctagttcctgaaagaagtgaattagtttgctagtagtgggtcaaaggtaactttctccttttaaaaactatgatgaaaggtgcgaggtttagatagtatggggaacttctgagtttctaaattataaaacacattttgaaatttgaattatgtgctgcttaatctggttcataattcttggtttcaaatactaatggaaatgttacttgcaagttaaaccctgaactgagaaacatgcttttctttattcttttataagtggctcttttaattgtagttcttttaaaaaggaagttaacacttaagtatctattaattcttgacaaggaccttattaaacctaagcaacgtgttttcaaaagggcaggtagctgttagctttatgtgagaaactaaaactaggaaagtaattattatgagcttcttaatcttttattttttccaaaatagaaatgtccctattttttcttattataaaaggaattgttaaatgtttaaaagtattgaaacagtactggacagtatacattaaaaagtgaatgtttcccataatcttaccccctacagatgaccactgattacagtttaacacatgtttttccagaacttgttatttgcaaatgtaaacctctattgctgtctacatatttaaaacattttaaatgggattgattgtactacatgtactattctttattttgctttttcttattgaaaattgttgttgatctatttccccttcagtaatgacagttctgtttcttagattgttggtttgttttgctattttaataacagtatgaagaaatacctcttttgtatgtttttgcacacttctctatttccctaggctaagttcttacaaatagaactgttaagggaaaggtaatgcatattttaaacttcaatatatgttcataaactgctctctaaaaggttttgccaatttactctcttgtcagtattgcaggagaaagtcctttttgactaactcttttacaataatatgaataacagtttttgccagtcaggtgagaaaaaagaaatgtatttctttgattattagtgtagttgagaagaatgtcatatgtttgtgggcctttatgtttctctcgggaacagattgttcatgacatgtaccttgtttttcttaagggtgtttgttttttctagtaatttaaagagcttttaatatagcctttgatacgtatgttgtaaatatttacatacgtctttttcttttacctcttatgatgatatttgttgcacaaaatacctaaaagttgacatatttacacacatcccattcttttttgcttatggtttctggcttttgtttgcatgctaagagtaaaaaccccggtcaattttttttttttttttggatgccaaggcactttatgtgcatgttcttattgaaacctcccagcaacccaatgaacagaatactttagcttcccttttatagatggtgggtaatcacttatccaaggctacaccgttttaaatgatagtgccataacacaaatacaggcagtcagatatctccctaggcccaagattattaatacaaacaaacaagaaaatctcctgtattgtagccactgtgttttctttttttaattgttaaatatttaattcctgtggggttcacctgtttaatttcattttcattttatactgtttatttatatatgcacatgtgtctacatgtttcctatatactcttattataataatcatcatttctttgtcagtaaaacattctttattctgattttagagtaatttttatatctaagggaaagtctccctctttattttgtctttaaaacttctctcgactattcacacatatcttttcttccagaatcaacatgtaaaatttaatgtacaaattctccttttaaaatagtctgtaattgcactaattgtaattgcacaattatcgtcattacaatatttatctttctattcaggaaaatagtatgtcttttaattaacttttttagtaaagctgaatagttaacttcatttagatttggggcatgctattgtaggtatattcctgggttaaattttgattgtgctcattattgttcacatgtacgtatgactgcataccattttgacagtgggtacatgttaaatcattactgtttatgaagtcagtgtccatttttatgaatattatgctagttcatgtcctctttttagacattcagtgttagagagtgaggaataattttaatgtcttgatggccaagactctacttaaccagctgttggtgactgaaagtccagtttcctttagatatgactcatagttcttggttggttcaaattctggatatcaatttaaaattgtatttaaaaccatagtggtccttaggggcccagaattcttcaaaattgaactgaaagtcacatagcaacatggaaataggcaggaagtcacatttaaattcttagcacaaattaacctccgcaaacaggtttgttccctgccctgccacccagcgtgggtgcttgtgtcacagtaggttctgggaagggttcagtattctcttgagattgggaggcacagaaacatcacacacattcacatggaggctctttcctaatccctccattactgctccctgtctcccataaccaagagaaaggaggcctttctttacaaagcgtgaccaaagattgtagaattcgaagttgaatggagagtgtataagaaattgaattcctaaaagaaatatgaggatgtaaagtaattacaataatcaaagaaggtcagagggaggagaaaggataataaagaggaggtaaataagaacatgaagaacattgaaccttccctttgtccccccaaaaaaagctgcagaggaagttggaggatatagaggatggatgaaaggggcaagacagtagaaaaatgcagcaaagtaaagatgatggaagtttagtaaaatggactgatacttacaggcatagttggcttaaaaaaaaaccctcactgatcctttcctttaaactgctcagtagctaaataaagaacttgttgatttctctctctttagcaggctctttcagtagtacattttgaagatttcttcatagaacattaggatattttactacctgactgaaagtggataaacagaactggaagatttctgctttgcacatttctgaagctttattttatccttatataggtaaagagagaagttatacactgagtatgccaaaatgaccacatgcttcacacttgcactacctctttttatgaatctaaatttggagttttcaaaacctcctgtttaaaaatacatcccaaaagacttctgcttattgcacattttgttcctgtcctgtacaactgagattttcatttataattctttttggaatgtttttctttttgtcataaatacaaaaggaagctattgacatataatccttcattatgttttatgcagtagcatcataattctcaaattttgagaatatatattttttctttcaagtctagagacaaatcttacaagaaagtttaattatgtgttcatgcatatacatggaatcttaaatataattgaatgaataaaaattaagttgccacaaattagtttatgcaggcatctttcacttaaaagatagtttggaggagaaaaaattcactgacaggtttttctattatatgatttatattttcctgttggatttcatgataaagttacagtttcattttatcaaagggaaaacttgttccttgatttttaaataggaagtcatattcagagatacattagtccttttaaaataacatatttaaacataaaatagtaatcttataaaatttattaagtcatacttagagtattaactgttttctgttatgctcaataaaaattataaattaaaaatgagggtaccagaaactcttaaaatataataatctatctctcctaattttactcataatataattcattaacccattattccatcttccaaaatgctaacttgcctctttccagctatcttgaaatgtacttaactgtaacatatctatactttaatgtatgtcactgaataagataaatttagagtatgtgaagtttaaggctgaatgttttgtggaattgttctttaaactaacccaaaataccacctttagactgctatagctgatactggagcatgtttcttgtctcaaggagcaaataatctttctaatattaaaccccagaatcagagagatgtacccatccagttttgggagtggtggacaactgcaggctcccctgcagggaaaagacttggcccctgtgagacatacagcacctggaggttgagcacatgctccctgtaggtgagctaactcccaggaaaaaaaaaagggatagaagaggcagactatacattgccctttttaaatctaccaggtcagtcactcctcctggaagaataagtgtcacgctagtagtgctccttccataaaaaaaactaaaggagtggggaagaatcattccctcccatagcaataatgatgtgtgtaagacagagttgatgaaaaaggaagtatggaatatggtgggaacatagcctagcctaggggttcattggaagtgatatttcagctgaaggaatagggagtaggattgaggaaggtgggtttgggcaagaagaaagatgtcttaacacatctgtggaatttacagcaattcagcatggccggttacagcctaggctaagagacagaatctggagtgatatagcaggatatgtaggcagtgaccagatctcagagtgagttgtgagtcaaattcagatgaataaagggcaacagaaacatttgaagggtttcaaatagagcgatgacagaatcagatttatgttttgaggggacaatcattctaactgtaatttggagggaagcaaagctagagagaggaagatctattagtggtatgcaaggaaaggaggtttgtgggaggggacgtgtagattagtatagttttataaattttgcccttgaagagcaagacattcaaataaagttgttaagaaagttagatgggtgcatacacataagtctttctgtgaatgccttttatttgaaatactgatcaatgggtttatgttaaagctagggtagccataaatttaattagccttctcccattttgatagagactttgtaatccttctgagtattttctttagttttctgatgaatccacttatttaaataaaattattcagttaaaaatttttttgaaagaatataaaaattcgctgtttcctgccactgtttactacaagatactgttgatatgtggtaagtgttctggtttatgggaggagaaaggaaagtttaagttcatttttgggaagacacatttccattgacattgaacttgctaaaattgcatgatcacacacaaagtgattgcacagcaatttttttttttagttgctgccaatatacaactatttaaaggctggactatttcaaaagataataatttgttatcaacattcttaggtgcagataaagagcctggaaccatgtctggtaaaacccttcccaatttacaccagaaagtctttggcaaaggtaatcttgtgctgcttagctgaaggcccttcagtatcaactaataatgtagcctgctgcctgctgtcattttttcactattagaaatattatcatattactatttttgtaccttttgtgtaatgttataatagcttctaaaggttttctcctaatattttgagaacttttgtttgcattcttgatttgaaacagtgtgacctgttagtgcctatcggatgaattatactctttgaatgtctctttttctaagccgctgtgctaatacactttttattcattttcccctgtgttataataactatgtttaagtctcatggcaatcttctttagtctatatatgctgaaaagatttatttgcatttctatccagaataaatcaaaataaattttgctggaaatggcatcatgtgaattgagtttctttagcttgcaatttttaatcattgtgctttatctggtggaaatgttaatgtttagtggcaaaagaattgtaaacagtgtttaacacacctttagtcacagacactttcatagaataaagggggttgtttaatactccaagaattactattcttatttgaattttatttctattgttgccaagtcattttttaaaaagaaaaatgatcccagaagtagataaccttttttttttttaataaagcagataaacttactgaaaatgacgtataaaactcaatttttctggtaggtacatactcttttgattaaaagttatcttaaacgccacatacctgaaaacacagttttacccattcaacaatcttgatgttcactgtcactgtgataaaggaaatccaagatattagatagcaatattctagagaaaaataaacaaattatatttccttcccctgatgaagttgtctagaaagctcatccaggccatggggtgagaccaagaagtgagaagttctagtgtctgaaaggaactgcagttgaaggactttattcttagcattatatatatgtatttttttaacctctctttggttctcagatcaacaccaaaatgcatgtgctcaccttctcttgtctttatgttttcagtaggaggaaggctggcattagcaatacaactttgaactcaggaagaaagtttagcctgaaaaagataggctgactagggtaaagtttgcagccttccaaactagcctgttatctttataagtttatgaggtagtaaaatggaaccaacatttctaacagaatacagtcgtgtgagcctgtcattctgaaagggactttatgtgtgctgaggtcaaaatccagtatgggaacccatgcagggcaggatccaggttttgtggcttattagacttgtgcagtttcatggggccctctttaagaaaaagaatgtggaattacaaatgcaaaattagtgaaaagatctcggaaggggcctatgcaaggaaagggccctgtacttaaacttcattaattcacaataaattcacttctaacctcatacataaacctgtatctaataagttaaattgtgaattgataatacagctaaatattttaaaatgagattgaatgtcacattcttgaggaaaccttccctgattgctttctttgtaatgccactgtgtcacatatacatggtgtggtaacgatccatttacccatctaatttgctcattagattctaagctgcagactggctaggatgtcttgcccactgctgtatcttttgtgcctagcacagtgcttagaaaattgtagttgttaaaagtagagtgcagggatgctggagtcacaacaccttcgaacgtattccagcagcaggctcggtgccgtgcctgatgtgccgaaaggtgcctctagtgctattacaatgcagacacagtttccatcaatcatatggacagcagctgccaagttctcttttacttggtgagttatggatggcaaagatgtctttcaactatgcacaaaaattggtaaagaactggctaggtgtccatccgtcaggtaggaaggagtgattataactgatctgaaggtagagtgagatacaaaatgccctctgaggatattttacttattcctgagagctgctgctgtctttgaacacctttgaacatttactttttaagacaattagatcaagggaaaaaatcatggaaagcatgattcaaagatcaaattcttcaatttgatgaagtcacacttcatctaactgggtcattgattttaaaccagaagcctatttactaattttacagcaaagatatttaactgtttctacaagtcatcataataaatgttatttctaatgaacagtgtcttgaacttaaataagagagagaaaaatagtggcatttcctctactccccaaataattctattattgcttaagtttagtgtttataagatttaaaaataatgggtgcaggttgggatgaggatctatataaccatggtggattatttttaatactgagaaaaacataggataaattctgcaagtactatactttttctgccaaaggagaaacatcctaaaacaagaaacttaggggctgatttaagaaaaagctggatgaaagatgtccagaccagctacataatttatagtgcccagtgaaaaatgaaaatgtgggaatcctggttaaaaactgttaatagtttcaagtcagcaacagcagagcattgaaccaagtgtggggctcttctaagcttggggcacatgttacgtgcccacgaagctagcccttatagatgcctttgcgtggttcctgagagctgctgtcaaagaccgtattcaccatgtaacctggtgaattgcaaagaaaaattcacatgataaattcctctttgttctcagcaccagaatagcatttatcacccgaaatgacctattacgttcctgtaattgagcaataggagctaccagaattaaatgttgtgctcaaatgaggtcgttttgctcagtctgggttttgggatgccatttcgttgttgctatttgactttgattttatatgcaatgttaatgggttttggtctttgtgttctaaggcatctcaaatccttttttggaagtagagacagtacgtaagtaaacaaaactcttaaaagtagttttaaaagttgattttaaaagcctatcatcaacattattcactggtggcagtaatagctctattaatgagattaatgcgttccaacaacataattattttttagagactccataactacaggcagaaataatccaggaaagcagaaggatgtgttccacataagcaagaatatataacaaattttaaatagtgagaaaagtatctttgtcttaagcaaagctcaggcaactaaggttaatggaggtgaaggttggggctagtttataattgggaatggaaagcccactggggacaagcttagagcgagggaactgctggcagacaaccctttgctgtggtgatacaggctcacttcagaaaatgtaacatatactcttttattccctgaagtttccaggagccttagctgggatcccagaacagtaaggaaccagtctggccttacagtgtgcatttgtgcattcttccccaatcatcccacaagaattaaattggattgccctttaagcagggctgccatgttcagttgtggaagattttccattgcatagactcattgggtaataggcagtggcatctgcgtttctccccactttacggcgatcaagctgcatcccctctcatggggctgtgctccccactacaccagtcccaagaagaggcaccatatgggctagtgtttaggactacctgagtcagctagataggcttagtaggcaacctaagtattcaagaatcccttaaagtgagaaaatgcctttccttatcaggaataaaaaacattgccaattagagagctctagaaagtgaaaatattttgagttaattttaagtatgaatgagtgctaattagagtggaattttaacagcagtcattctccactttttgataagattatgggatgtgaaggaccagagcctctatgtgggagttgggagctaggaaatgcagaaaattgatgcagaaggaaatagcgtttctcattacgttggctttggtttacatgcctccttcctaaaggacttgttaatttaactattacttgtatatgttaattgaagtactactcgatttgagtgtaattttctctaagtttttcttatcctttggtacaaagaaatcatttgtattccattgttaaaactgatgaaaacatgtgaaatcatacatgaagacatggaaagatacaaactgaaaaatgagttaacattgttgtaatattaaatgggaacaaattaatttccatcgaaggtaaaataatgagtgcatttgtgatttttgttgcttactcatcataattatgagacattatatttaagcacatataaaataagcacactttcacatttaaaactctagtgatcttctgtatggaacttacactgaaataactgccctagctggggtcgtctccctccttgattccatcgggcttggctgccttccctcaatatgtgttgagtgactactgtgtgccacgtttgttcctagaggatccaaaacccaaaccagaagctcccagggttgcagtgtaattaatatggggtgtaattatagccttttatgatagtctgtttctttccttgttactgtagtcccaacacttcctgagatgtgccctttaaccaagtttgtcccaagcctccacatcttaggaaaattataaacttttctgtgttctgtcttttctgtaaaacctttacctgtccccctagttggacctaatcacttcctccctggtgtttcacagagcgcctcaaaatttacttttctatcgtagttatttctatttgtgtttttatcccccactaggtttcaatgtccctagaggcatggattctaatgaattcttgtatctctattgctcatgatatttgcagaatgcatttctcataattggtacttactcaaaaatatagcatattacacaaatcagattggattacaataatggtttgcatgccaccagttcagggacacaggttgttgaccccaaatactgtagagccaggttgagttactgtcagcattcttaattcatgtttactgcataacagaaaatttaatgccctttgcccaattcctgaataaatccactattatcattctctgctcccctttctaatctgctatccatgcaaacatcatttccattaatttatgagcataggttcataataaacagttttgcgtgctgtactcttctctcagatatctaggagactcaattaaactaaaggaataagcaattttgtctataagtataaacttctgaaaaattgttgcccccaaacagcctttaaattctgagagaagcatgtctagaggtttcttatcaagcttcagaaagtacatccttctgaacatttttaatggcagctcataattgctgcccatatacatcagaggattacctaaactgggcttttcctgcagtgaaacagtgtctaataatttgagatgaaattctaattattttaatgagatttttctgcttcttggcatcaagcaatttgttttacacctttactcattatttttcatttttgaggacttaaatagaagagacatgacagaataggagtcctgtttcatctcttggaccattaattatgccaaggcggtttcagtactgatgagaccccaagaggaatgaatctttttgggtcttacttggtttaacggatttcattctttatacttcaaacaagttttcttagaaaaccattaatcactaaactatggattaaatagtgacaataatggaaatataaccaagaacaaattgttcatggttggtttctccaaggatttgacagctaatttataaaacaagttgtttttgttcagcaggacttttgtgactaaagtaaaattgctttggcaaaaggctcagcaatattctatagcctgtaggggaacggagcacacacagaccttcctccttctttcttgaccctctttccttgccactttttgcaagatttcaatttgcatacctgtcctgacttgttgccagcatgtgcccttgaaacagttactaagtttgctagtataaaaggttctgaaatttgttttatcttgtcaacacaaggtccacattggagagctttcaagacatactgtaggaaacttggcaaataggtaaaccaagtttttttttttcttaagtttggtcttcattttatatagtcatctgcatcaattacattcatagtttcataatccaaacaaacactgacataaaatatgtaagggttgctttcttaatctggacgttttcacctttgttggttcttcagtttgcctagctgggtgatgtgtgttagattacgtagttgtgtgtacaaagcgagagctttctcccttccagacacatgttatatgagggaggcagtgtaccaggtattacagagtgctggtaattaagcctgtgctgggaaaagtagggccaaaaccaagaacacatcttggatgcttccctcaagggtcttaggtgtagttggggaacataattgtatttaaaattgtgaataacagtaaaaagcagtgactgataaattgccaatatgtagaagagagaataagtgttatagaaatctagagaaggggtaggtaggctagagtggccaaactaatgttatttcttagaaattgaactgaccgttttcctcattcattcttttattccatctactcatttattattaaccaccttattaataaaaagcagctaacctttatttagctgctcaggcactgagtattatatgtacaactcatttaatatgccatcgttttgcagattaggaatccgaggcatagcatttgaccaacttgataatgagtggaagagactggtgagaaaccaagtctgtgtactccagagcctggctcttaaccagcatgtcctattgttttttgcctaacatttgctgacagcttgtcaagtagtaggttcacagagacagctgggatatagagatagtggaacaaaatccctccatttgagaaaccacagaagtaagtttgaaggccaaggattctgttgcaggacagtgatggtagcttctgaattcaggggaggcacacctgtgggaacatttggagatggagagaaggaagttaatgaccaggtggtagaggactttgaaagccagaatgtggggtttttgtttcatccatagcttcacatgtcatcttaggaccctctatttgggatccccccagagcttgtgaaaaaagcccctttgggatcctttgcccagagctcttgttcagattcttcttaggggtagggctctgaaatttgcattttaatcaagcaccctagatgattgttatcccatttgatgtggaaaatcactgctgcagataaaggagtacatatggtaaaacaccatatttgtttatattttaatatgttttgcttaaatgaaaacatttttgtgtggtataaaaaagagaaaatctttatcactttatcaaaatctgactatcactatattgaagtttaccagaggtatattggaaatatacctccgagagacccagtatgtcttataggcagtggtattctggtaaatgttttaacaacgaactctctgaaaacaatgcacaagttttgatttgtagcatttgttgatttcaaggtaccaacttaatgtcactgaacatggggttaggaagagatgtacacagttgggtccggttccccactgcctaactgcctatgagtttgaccagtgagtgaccggcagtattagaagtattagtgagtatttacaagaaaaaatatttatatgtatccaggttttataaacttttaaccacttaggctgattggaagttatttgcatcataacttaactttaatccttaactattttcaaagcatgatctcatacattacctttgaattttgcaaatattctgtgagattgccatggcagggaagatattagccttattttgtagtcgagaaaattgagagcaagtaaatttaaagaacttacctaaggtcacaatgctattaagagacaaagactgattatttctagtcatttctcttcactgtatactggatcaatactatgtaacaagctacaggttacaaccaagggggcctatgtgtacaatgctaagatactgacactaaggatatagtgaaatcataatttgggtatattagtagaggtgcttctacaactgcacatttctttgcattatactgtatgaatcatcgtcaagttgagacaggtagggtactccttccaccctcactggagttgttttgttgtcaaacgcagagatgataaacttgagagaaacagttcagagactggaaaaagaccaatgaggagctaatgtcacctggaagagtcttatccttgttccagtggctctcattgcatgatccctgagacctcctgcagcatcagcatcaactaggaacttgttagcaatgcagatccttgggtccccacctcagacctgcacacactgtgggctgtaatcgacaagtcttccaggtgactttgttgcttcctgaagtttgagaagagccctatatcatcccctccaacccagaaaccctagagaagtttgtgggatcttaaagaagagaaggcatgagtgtcttattccaagttgacagagtttaaatcagaagtaactgagtagtcactaattagattgcatttacttgaagtgactcaattaagttgtctgctgttagctggaattgggggtttaaggtaggaattaagttcagtttacggaaattaagatagttacacatcatacacacctgggtttgtagcttataaaatagaattttctatgtacactctggatgcacttgcaattttgtcctggaatgaaccaaacagatgaagtgaacagacagaccttggtgcctcatgtagtgtcaggaggtagttcatacacttggccgaattaagactcatgatgtacggctgtgggggtgggggcgacaaagcttttgaaatggcatgctgtggcaaaatatgatccacgtgagttttccttggcctttggcaccatggactctggccccctaccccatggccttgacttccctgacctgattgtgcttagtgcttctcctgcagcttggcaacgtgcatcatggtctcaactagtgctaccgactcatcccagttggcttgagactttctcagttttaacaaagaaattcccatgtcccaggaacctcttagttctgggcaagccagtagagttagtcactctgttcgtatcccacttgacttaagacctccactgggtgttttctttgctttttccactggtgcaggttggtcccgcatctttggcaggctggcaaccccagcttacactgttgttggttggggagccagggcaactggctacggagagttgctgtgaaagagtcaactattactttttgtacatgtaagatttgtaggaagcatgattagaagttatttttaggctgtgttgagtatttcttgctgatttggaaatatctagtcacatgtaactgacatagtaatttaataaattaccaactgcaatttattaaagcttggaaacatcttgctgtggagtgacttcaattaaggaaaatcactttgagtggaatttgaaaacttggcatggtactggggtattggttatttcgaataaatgggtgatacctgaaggtggaatcttaagaaaattaattctggcatatgtggaataaaatagagggattatgagtatggaggctcatgggagaacacatgttagtctaggattgagatgataaaggcacactagggagttaatggtcagaataaaaggaaaatttttgaaagatattttgaaggaagaacggatgaagtactgagctgggtaattgagagaatgatgacattattaatgaaaaataagccagcctaaatttagacaattgcaatgaattaaactttaggactggtaagtgtcaggaactcagatgatttcaaacagttaaggatttgagataaggcccaggagaaaggtgtgggctgcatatgttcatttgtgagcatcttatcaaaggtgatggttgaagcactggagttggtgtagtattcttgcatcagtaggtaggtgatcatcagaagcagacagctgagttgagtaatgtcaatggccataaatcttttgtttggtccttaatacatttggtgctatgaaattaacatttattcaggattttattgtggttccttccatgctattttagcagtgaaatttcagtgaaccaattagaacagtgaacttgattgcacatgctaatgaagatcttcttaattaacttttaataataaaaactccaagttctcaagagctagtttacttccataatgataaggaaattagagtttgagcataccaatagtagtgtgatcccttgatttctacagcatttataatttgcaaggcattttattattttatcaatgaccaaaaccctttgggacagttggctttctctctaatttatagataagtaaactgagtctcagagtgagtgcgttgcttgcaaaggcatgtagtaacatcagtcataaccacgtcagattgtcttttagttctttgaccgatgaactttccacagtgccataattgctggttgccacacattaacactagcgtagtgggaggttcctccagtatttccccagcgcagtgtagatttcagaagcttttgatgacatgccttcattaatcagagaaagatagaccctctatatatagaagttttgatggataaatatatctgacattgctataaggcgttagtaccacaatttttagattcagtcatcttcactgagaacccaggaataaaattaggctgattgagggcagaagaaggctgagccaattaaagaaaaccctgggaagccaggattaagtagcacaaagacaaagatgagtgagctgatgaaattgcacccctagctgaaaagcagcacacttgaaggaaaaccatagaatgttccgctaacttttagcagtgggagttacataatctaataattaattgtctgtagcttccagatctattagggaggtgtggaacagactccagaggcaaatcactggctcctgtgcaagtcaggaacattgccttaggcactcagcttcaaattggtaatgtttacaagttgttttccccataattttttaactctgggcataatctttttcctcttaatgggtattttaagtgtatcttaaagatttttcaccggctttacacttacgattggaaattgtctagtttgtcactatacttctgagtgtcagagtacacatcttatttttgttttttttttccccctaaaagacaatgttcaaaatacaaggtgatagaatatccctggcacactggagaaaaactgagatcatgtgcaaacagaaggatacatccttttaaaatagtttaaactgccattagaaatagaaggaaacccattttatctgggttactttgacagatgtaactctcacaaaggatgaatatcaaccaccagcaccctcttgtctgacattctgacttgaaaaggaagagcccctgcaaccacatagcatggagaggagataggagagaggctgtgagtagatgaaggctttcagtcatcaggggccataggtttcgttttgatgtacataaaagctgaccaaggactttgtgaaaactttgggctgccttcctgaccaccttggtttttttccttcacccgtagatcagcgtcattgacaactgcattcttttcaagtggcaaaaagaagttaaaaataaaattctattttagatgtacctttgattttcttcaaaaacatttcagatgacatgaaagagaaatacgtgataaattttagcagagacctggcagagtcttcctatagtttaatcaaaaatgggctcagtttcaaatatattaagttgccacaggagaatgggaatgacttttgggaacagttaatagttcctggaattttaatccccttttatcacaatactgggtaaaagttccaaggtaagtaggcaaataatacttaaaggaatattgcatgaaatgtaagaggtgacgtatttaaaagaagtatccttgtacagctcgcctttcctgtgataggtgctgcatgtttttttttttttttttctggataatttgtcctggactttgtccaggacagaaaacttcggtgtttctaaagtttatttagtcggtctcatctccttaacaatgtcagaagaaaccttttaacttggaacttggtaaaagtaatagaaaatattgtttaagatctaaatgtaagcatttggggtgaattctttaaaaaagtctggctatttcctagatttataactgcaaatactgtacaattaaaaccaccatggtattcctcatgattcttcctatttgggtattgatgaaggccttaatcaaccatagctgtttagaattttgagtgtagattgtaatttgggatattttctactggggtcctggatttgcattgtgttctgatttcttaccctatactgcattttcccctatggaaaaagtaccttccttgtattggaattttttaaaagattgcagttatttgtaatttgtaatcccccagtgtttctagtttatatctttaatgttgaaatatgaagaatattttattctattttccaaacagctggtaagagaattcctctgagaaaaaaatatctgcctggactctcacagtcgtctcctaatttatctttctgcttctgctttccatgatttaatttttttttgtacagtatccagagtgatcctattaaaagtcagatcacgttactcctctgctcacaaccatccagtggcttcccatcttatcagaacaaaatctagaaaagtcatcctcttccacggttctataagtgatatgcacctcaaatctttctggcctcatctgtaaaaaccctcttccttgttcattctactccacactggccttcttgctggttcttgcatacagcaaacacagacctacttcagggcttttgcatttccctttatctcttctcccagaaatttgcattatttgcctctcctcctttctttcaggtctctgctcagatgtcactgcatcattgagaccttccttgaccatctgaagttaaataggaccagtacttcaggtgtatacagagtccagaccgtgagatctttgatctcagaaattaggagatacccttaggggattagggcttcccaggttctagaattgagatggtcgttctttctaggtcttaaaggccaggggaccccagctaaaatttgggtaacttcaaaatacaaatactttcacttaagttacactgctgtttatcaactatgtgtctgtagttatttagtttgttaattgttactccacaaaacaaagtatatactgaaaattcataaagcctatctttttgcaaatgaaaatgtgatctaatggtctctttgtgaattccttcttggaaatgctccattattgtcatagttggtttatagccttccttggtgttaaaaagagaaaagatgttttctctttccattattgggagctcttttctttctgttgtttctgttcttcctgccctgtggctgctcagattctgtgtacagctgtttctatgaagtaatctgtgatctcctcacgttgctgcctctttgttgttttcactacatgtagaccacagtgtcacaataagacaagagaataaaataaaatgtttcctattttattaatgatttaaaagtccaatgccattattcaatgaaaagcccaagtcaacaacattttagtgtaatttagtgagaagtgttctggtcacttggctcaaccatgcctgcaagccaagtttcagtgtttcctgacactgaatcgcctgagtaccattgtggttatacatatggtgggatgacgtggccagttgaggtatatgtattaatatgctgaagaaaagagagtagtggcacttgcttcgtgagccaaaaaactgcaatcacttttaaatatatgccacaaggctgtgctgggatatgaaggaaggtaagatagagcctaggtctgtctagggattgggctgcttctgttatataaccacagcaagtcagttcagggattttagcaaacctttgggaatagcagggactgagctttagatgatggctctgaactgctggtttccaaccactagggtgctctacctgtgtcagattttcctggatcccatgcatttccccagtccatggtaaaggaatcactgggtatctgcttgtcattccccaatacacagcattctaccacattctgacttagaatttccttaccactattttccccccactagcctctgaggagctttctgaacatatagcccaactccttgtatatgtaaggcatttgttacactttgatggagaaatgaaattgtgtgacttaacaactattatattttcttttcattaatccttgtactatatttgcatgagtagaattttgtaaggttgtaagctctaggttactggaagaaacagaagtccgattgatttgttctgagaaaaatgactggataacaaagctaggcatatagagttgaatttaaatccttgagatgatctaacctgataatgtaacatcatccatctgtaatattttctcagtcaatttttctggtattcttcattttctttttgagaaagtgaagcatatatttatagcattatagcatatatttatgccattctctattcttaaggaatagagacagtattattttctcttcaatctgtatttcatagtgacatcaaagtaaaattctacttaaattgtgtgctaatcatagctttttatgttttcccttttctgccttctacttttttctactatatctccacttcaggtgcttctctcacattttccttaaatgtttctgtcagttccttagtctctacaattcaagagatttctatgaatctcttggtctattatgtacctttagaatggaagggtcttactagaaaaaaaatatttttatctgcatcacatttgttgacagaaagagaccttcatgctctgttgttaggtgcataaactagcacaaaacaatagatactgagtgctctacttctggaaaaacaaatattttgttttagctatttgcatatgaaaagatgtggaaggttacttatcaaaatattaactgattgagaatgtttagagtcttgttgattgcagttttccttctttcttttttccccactatttcatgcattcattcacatagtcattctttttctgtgcatttttattttctgattttctgtattactagtgtaaaagcaaacactaattgggaaaatatacaggaaaaaatgttcgatggatgtaaagaaataattgtgaacgtttatagcaccaatggtgctacgaaactattcttgacttccttttctttggttctaaggactaaagcataatccctacttctttggagctttggagggcttggattgtgtcttcctcttagagttagaatgatccatgttttgccaaagtgttcaagaaagggccccatgttggatgtcccttacagctttacctgggcatggagaaggcccagtcacacagtgatgacttgtagcctctggacaaatgtcatagaatggctgtgctccttccaaattccactcagagtggggacagctctactgcttgctgagcagtctccattcagaagtgtttcccttaaataatatggcaaaagccaaaaggtaagattggggaagaaaacgtggacctaggctaagatcatctcctctcccccactgccacctacatgtttgttttgtttacttgaatgaaacatggagctgttttaaatgtctgtgtaacacagtggtatcaataaaatgcagcttagttaaaaaatttattttatttttctatctgtgattacgttaagcttccgtgaaaatggaatgcaccagtttcacagcaggagaagatagatacagcaagattagggaggcaagatgttcaggattagaaggatctgtatggctgaaagtgaggtaatgataatgattatgtgataatagtactgttgtgctgttttgtgaggcagtaatccagctcccaaagcagataaactatgggggagaaggctgagtttatcccatggaggggaatagactgttgctgaatagcccagcatgacagtaaggctctttcttttttgaggcaagagctcaaaagtaagtttttaaaataaaacgagtaacttcccaaatacgaacaagtgaacagctgagcaagggtaaaagaaaatccaatagtgcaggagggtgaggggttggaggggtggggatgggattctttttatgcaacaaaaactggagttctagtcatatgagaaaaaaatttcagggccaaacacaaaaacaaaacccccctactatgcaaattggcagctgaaatgaagtggtattttctagaaaagtattaaactactgcaaaatgcaaacagatttccattcatctcattttaaatcactatttgttcatttcttgaaaacttgcttcatggaagggactgtaattataacagacaaatggcatattgtccttgacttctctgagcttacagattggtattgcttagtaagatgttgcggctaggcgtgctggctcatgcctataatcccagcactttgggaggccagggcgggtggattacaaggtcaggagttcgagaccatccttgctaacatggtgaaaccctatctctactaaaaatacaaaaaattatctgggcgtggtggcgggcgcctgtagtcccagctactcgggagcctgaggcgggagaatggcgtgaacccgggaggcggagcttgcagtgagccaagatcacaccactgcactccagcctgtgcgacagagtgagagacagagtgagcctctgtctcaaaaataataataataataataataatgttgcaatagctaaatcttcactttttcttttgtattcaggattgactggaaagtaaatgtcactcagtctgaggattcctccttcctgatatatatctatatctgtatctgtatatggacataacatatatatacatctctctattatctaatctgcatctatctatctatctatctatctatctattgatgcattccaagcttattcagttctagaaaatggaggagggatggaactcagtcctcagttcatactgatgtgacttctcctgggctccttgcttaggcatgtggggccaatttgatttggatgactccactggcagctggtttcactctaggacagctgggaaaattttgcttcatctcccaaaggtttactgcttagtactaattctttctcccttgcaggctgccagcaggcatccccttgtggtatcgtcacatcagaggctatgctatcaaatgggttcatatgtcttccaacctgtagaattgcaacccctgacttttctatgtatctggaagctcttagacaccccaagggatggagccacttctaacactgagacctcctcttctcctccatcttcaaacaaaaactctagctcagtagcctcatgggctgtagtcccagctactcaggaggctgaggcgggagaatggcatgaacccggactttgacctcccaatgcaaaggcccatttagcctctgggggagcccaccaagatagaacttcttttcaacttaatcactcaaaaaggctaacttcaaggacactgagattaccttcaatgttactttttgggagatgtgagaatgagaaacaatagctttcatttctcttcattgaagctaaatttgagaagaataagattaagttaaattctcaggagcttattctgccaccccgaattctccacaaagtccctcctgtacttaagaagagggagttttgtgctcgtttgttcaccattgaatccctaacattcagcaaacctcttggctcaggaggcctgatatatatttttgaaataatagtgaatgaatcaggcttaatgtttccagaagttagttaccatgactggatcagtcattgcttatatctgggaacactgaagagcattaattcacagataatcactgagtctatgtaccaggtgcttatctgggcacttggaatctgtcactgaacacaagggcaaagacccttgccttcatggagctttcattctagccaaggagacaataatcaatgaatttattgaaaaagtaagttatctagtatgctaggaaatagatattatgggaaaaagaagggttgagcagggtaagggagatacagagtaaggagcagtttgcattatgaagtaggtggttggcctcattagataagacagtgaacagagacttagaggtggaagggagtaaagtggaatttagggcaagagcactctctgggcagaggaaacagctacagcaaaggttggaagtctgcttggcatttttactttagtaaaatacacataacaaagtttacaattttaaccatttttagtgtacgattcattggcatttcgtaaattcacagtgtgcagacatgactactgcctagttccagaacatttttatcaccccaaaggagaacccatattcactaaatagtcacccccccattcccaccttcctcagactcccggaaattcctaatcttctttctacttctgtggatgtctttggcattttggggaggtgaagaggctcatgtgggctggagtctagtaagtgaaggggagtttcgtaggggagaaagtcagtgaagtaatgggggctgagccggatccctggtaagccactgtaagaactatgacttttactctgaacaaaatggagaacattccagagttttataccgaggggcaaaactctatgcaagagtaggtcgtatgtgtgagacagggtgagaggcagattgactaggaggttatcagtgtaatccaggtgagaggagataatggctcagaacagggtagcaagagtgagagtgctagaaggaattgaattttagtaagattttgaatctaggaccaagagaatttgctgtaggcttggatttgggatgagacagaaaggagttaaggattctccagttgttctaacgtgagcaactggaaggatgtagttgccattaactgagacagggaagctatggctggagcaggcttgcaggggaatatagggaatgctgttttgggcaggttgagtttgagatgtctggtcatctgaataaaggtgtcaagcagttagtgggatatgtctgtctggagttctagaaagagttctgttgtggagaaaaaacaacttgggagtcattagcatagagatggtatttaaagctatgagaatgggggaaatcgctgagggattgagtgtgaactgataatgagaagaggccacgtggtgagcactggggcatattctcctttagtggtgaggggcacagaaaaaaactataaaagaaagaattgaagtaggagaaaaatcatgggtgtgtagtgttttggaagccatgtaatgaaagtaaaccaaggaggagaggtcaactgaatgagatgctgctgaagtgatggacagttggctttagcagattgtggttggatcaaaagtcatatgggaatgggtttaagggaaaatgaaaagaggagaattgggaacagtgagtagggacaaatatttggaagactttctcataaaagctgaaaaaaatgagggcagtacccccttcttcggtgcctcaccttcactagaaagctccatatttcttaattattctaacaaataattatagttaattctggtgagtgatgcatttctttgcaaaatattgtctcagtttcttcctcacagtttctcaggatgctctttgtcatcatttaaaaagaataataaactaatgagcaagataaggagagaaaagaaacagatctgagagaagattctctttctggaacactaataataagcttaatattttacaaaataaaacacttttaaaaactatcctgtaaaggtcttatttatgtactttttataggttagcttataactgtttctataaaaactaagaaaatgtggaaaattttgaagtcatggggagaatatctgaatagcttttcctcctagtttcttggaaaaacaggaaattatatgcaagactcattttaaggcctttacagtgtttaatttacttaagtacataaaaatgtattatgtataacttattaaatgtattatgtataactaataaagtcgtgtctgggataattaaattttaaaaatatggtagattaagaaagcaattgcagatttactaattgaatttgctatttgatgtttttaattttttaaatcacaaatagggttctaaagttgttgcagtgaaatgaatttaacatttcttatatgctcaattaattgggaagcaggcaaacacctgaacaaccatcatactagtattgcacataaatagatcctgttttagctagttttatgctcgtatgacattaaaaaattttagagacaagttttctggaaaagtagctgtatcataaaggggagaaagcccttgaatgtattgaacatggtgggcatgaaacttggtggaattgttggcagtttttgaggtgtcactttccacagtctcttcaggcacattggttcatgtctcattccttctcgcatgctactctactatttcatttgatcattgttttacaatttccgaatgaaaatcagcttttttcatgcactacatgagagggaggaggctaaaatgcaataaatgatcttagaggattggtctgtaaaagtcttctcaccaaggctgtgggaaggaacgtttcctccaagaactatttggcttatttatctgctatgtgccaagtattatgctaaattctgtggtgcaaagatgagagctagattcattcattcagcgatttattcattcagtcaacatttatgcaaaatcatttggattattcaaaaaatatataaagacagtcattatcctgcaacaattgaaaatagagttaaagcttatttttgctttgtaatttaatcaaataaacaactatgctacttgctctaacttacttttctggctttttaagtcttgagttcaaactactttcagctggaatcttagggatacagttgaggacagtgctattataccagttttcccaaagctcataaaaaaatcctaattaatctttaacttatattctttacattttcatattttggtatatattttcttaaaacaagaaaaatttagtgaattcttaaataaaataatattttcataaaatctttcttcagtctgggtgtggtggctcacgcctgtaatcccaacactttgggaggctgaggtgggcagattgcttgaggtcaggaatttaagaccagcctggccaacatggtgaaaccctgtctctactcaaaatacaaaaaatagctgggtgtggtggcacgtgtctgtaatcccagctagtcgggaggctgaggtgtgagaatcgcttgagcctgggaagtggaggtttcaatgagctgagatcatgccactgcactccagcctgagcgacagagcaagactctgtctcaaaaaaaaaaaaaaaaaaaaacaaaaaaaaaactttctgaacagatctgttttttaagtgggtagttttacaggggagaggttatttcctaacgttccttcaagtgagcaaatctgtcagagtttgctgctccccacaggcacctaccattctacccccaaattaactctttcttatcaatgaaaggtatttccatttttttctgggagagaacaccaattaaatagttaggtaatttggtacctaatgtctttaacatttcttattaataccttatgaattataatattataatcttccttttaatgaataggttatactcccctgcaggtggaacacttagatgagaagttgtaaatatctttaaaataagggtttaattaattataaatatgcctgctaattttaggcaggattctactctaggaactggaaaagaaaccaagaaaataaatgtcttttcagctgtgaagtaaataaccatctagtgagagcaacagagtgagccccacattattcaggtggaattggattaaaaagctctgccagtgagataaaaacaatgggatcagtggtggactattgaaataggaaggaaaaccataccttatttagatatgatactcgtataaagatgttgaaatgcttttatttctctgcattgtcatatgattcaagttgggatgggcccatgtaagatagatgaagcagaagagcaaacagcattgggtttagaggcaacatctaaaacaatgtgattattttgcccctcacagaaattagtgtctcagtaaaagtaaatacatttcctgggcaaccagaaacatatgttgcatgttctttccagtacagtatgaatcctcagtaagacaaaaagagaatggttctcactaagcaaaccttccaacttttatgtccctgagccttcagttgctgttgttggttgttaacatctggctttccatcatcccacttttctcactcatagttgtgggcttactgtgggtattccttggtagtctatcaccaacatgagggcaagattagtagatcaaaatcttgtatgtttaccacttagctgagagccttacacatagtcactgctcaataaatattttttagcaaatgagttaccacgcaaatctcaaagcctttcttgtattaaattctagagtggtctttgaggaatcaccacactgtcttccacaatggttgaactaatttaaactcccaccgacagtgtaaaagcattcctttttctctgcaacctcaccagcatctgttgttttttgactttttagtaatagccattctgactggtgtgagatggtttctcattatggttttgatttgcatttctctaatgattagtgatgttcagcttttttttcatgtttgttgggcacatgtatgtcttcttttgaaaagtgtctgttcatgtcctttggcctctttttaatgggtttgtagaaataccatttgattcagcaatcccattactggatatatacccaaaggaatataaatcattctattataaaaatacatgcacatgtatggtcattgcagcactattcacaatagcaaaggcatggaatcaatctaaatgaccatcagtcatagattggatagagaaattatggtccatatacagcatggaataccatgcatctgtagaaaggagtgagatcatgtcctttgcagggacttggatggagctgaaagccattattctcagcaaactaatgcagagagagaaaattaaacaccgcatgttctcacttataagtgagagctgaatgatgagaacacatggacacactgggaggaaacagcacacactggggcctgttggagaagagtggtggggggagggagagcatcaggaagagtagctaatggattctgggcttaatacctaggcaatgagatgatctgtgcagcagaccaccatggtacacatttagctgtgtaacaaacctgtgcattgtgcacatgtacccctgaacttaatataaatattgaaggaaaaaaatacaaaaaaaattctagggtggactttggagaagatggagggcagggagattctaagaacaaatttttgtgacactctaaaaacaaatgaaagtgacattagtcattgagcttttgaattttttctggtaggactttacctgcaactaaagaaaaaagatggacaacctttaatcttgtatcacatcaatactgtcattaccttgtataaaatttccatttaatgcatgttctttaactatctgagtgataacaggtgaatgacatttttgtatatgcgtatgtggcttacatatttcccaattctgcaaactaccatgaagttagtattagaaacttactttgttatggttagatgagttaaaggagggaaattagatgcactgtatatacgtatgtccccgagagtgcactttccatgaatgatggcttgcatcttctcattttcctagatttttcacttctatcactatcatgcaaataattacaaatagcaaataattttaaatgtcagtaagctagtcttgagagcatgcagcatttactgtcatagagcaaaataaattaagtagaagatgaagtcttctgccttcatgaagttagcattcagtagagaagttgggacaaaaaaaatatgaaatatttgttgccatctacaagagaaatgtggaactacaaccatttgcagtgatcctcaagtcctgaagtggggcaggagtcaatgtggccactggttccaggaatggcctggagaactacaggcagattgtctgaaagcagagagcatatcaaccttctcctctcttcatgggtaacagatgcaccattaaaatgtgaacatcacacatgtaaatcttagactttaatgtttttataactgcaaaagtatagcttaattagacatatataatgaacctatcctatatgtaggatatatatcctacataccctaaggtgcatgaaacataggaatgacttcagaaatatcaaaattaggaatccttctctgttgccatgttttgaaggtaagatttttggagttgtatataattcattttttaacactttgaatgtattactttgtctcaagcctacttaacaccaaagcacattcataaaagcacttagctaattgtgaaagctagtaataactagggaatctgaacctgaaatcacatacttttttttttatttttgttgattattaaaagagaaattaagttatttgctcatgtttatattatggtaggtaaatttaactcccaaaccacaatcttacataggtagacttgcaccacgggactttgctgtacacattatttcatcacccaggtattaagcctagtccccattagctatttcttcgtgaccgtctccctcttccatcctccaccccagtgtgtgttgttcccctctatctgtccgtgtgttctcctcatttagctcccacttacaagtgagaacatacaataattggttttctgttcctgcattagtttgctaaggataatggcctccagctctatgttcctgcaaatgacatgaccttgttcttttttatgactgcatagtattccatggtatatatgaaccacattttcttatccagtctactgttgatgagcatttaggttgatcctgtgtctttgctgttgtgaatactactgcagtgagcatatgcatgcatgtgtctttataatagaacaatttatattcttttgggtatatacccagtaatgggattattgggttgaatggtatttctgtttttaggtatttgaggaattgccacactgttttccagagtggtcaaactaatttacactcctaccaatagtgtttaagcattcctttttctccaaaacgttgccaacacttgttattttttaactttttataatagccattcttaatggtatgagatggtatctcattgtggttttcattttcatttttctaatgatcagtgatactgagctttttttcatatgcttgttggccacatgtgtgtcttcttttgaaaagtgtctgttcatgtcctttgcccatgttttaatggaactgacaaaccacaatcttgattgcttaatacaataaaggattatttctcaccatgtcaccatccagtttgagttagtattcgtggtaaggggacaggtgttgggaacctttgctctgcccaatcttttaggaattccgatttcttccactgataggcttcactatcaaggaaggctgtggagtccccagtggatcctctgcatttggcctggaaacaagggaggaagaagtgtggaggattgtgttgaagggttcatttttcatccagaactggaggtgctagccatcacctctgaccacctttccttagccaaaatttaatcatgtcattccacttaacttaaaggagcctgggaaatgtaatctagccctttgctggggaggaaaagaaaacagagttttgaaacatgcagcactgcttctgccatagtgtttaaacatcatgcattgatgtaaaattttctggactttcaatatacatcaaaagtttccagcttaacacaaagtcaaatgaaaaaggaatggccaaaaacataacaaacaagaaggaaggcatatcaaataaattggtgaatttggaagcacctattttaaaagaaatggctgtccaaagacagttctagtggaaatgaaaggcaagtaactctatttcaaatcttggactaaatggaatagtgtaaagagttacctatctaggaatcctcattaagtagccatacacccttggactattcacttatcttctctaagacttgattgccttgtatgaatagtggacataatgctaatatatgttttcatgcttgctttgaagcaaacaattatatatatgagggtgtttgtgaaatattaattgctaaacaagttttctttcaggctagttgcattaaggaaaaattacttccaagaccacctgtaatattcacctatgactcatgaatttccagttggctagagtagcatagaaaggctttcagatttgtaaaatcaaggtttatctgaggtaacctttgctgcttgttggaagtatgtagctgagtaattgttcaaaaatagcaggttattttgaggtagaacatatgttctttaacaaataaaataagtgttctgaagggaaattttatagcatatttaatcacacacttaaaataatttaaatctggcagtttagagcactgtgtactttgatatgattttttaagtgctttattaagtgcagtaatactaaggtgagtactattgtgtggatttgcattttatgagtagctcttttcaacttctgtaaagaaaaaccatgtcatgaataaccaaaactgaaaaatgtagactaaacattttttatatttgatatgttttataaaattatgaatatatgctttttatatacacacatatacatatataaattataggtatgataaaagtgacttgtttcataagtcaaacaagcaaagaacccttttttatttatatcaacctgttaatgcatgcctcttggttgttggatgtattcatttaatagacatttaaagactaagttgttgttggtagtagggagcccagtaggtgttttcaggatattaacaaaaagcagccataacttccagcacagagctaaacacatagctgatattcatacacaagaaaaataaaatgtagtcaagccagtattttggaattggtcaggagacagataagtggtataaatatggcagagtgagattctttttaggttggagagccgggcaagacaacatcatgaggaaggaagtttttcattgattcttggagaatgggaaaaatttagtcatgtgacagccataagtcagacagggagcatggtatgagcaagacaaagggaggagctgtttgatttgcctggagaattaaataagtacaagaatattggaaaattattcagctcggaaacataggttgtggccagactgtggataaccttaaaagcccacagctttatggatagttttgatgatgtgacattgatgagttttcttttctttttctttcctttttttttttttttttttggagatggagtctcgccctgttgcccaggcgggcgcgcggtgacgtgatttcggctcactgcaccctctgcctccaggtttcaagcaactctcctgcctcagcctcctaggtagctgggattacaggcacgcaccatcacgcccagctaatttttgtattttgggtagagacggggtttcaccatgttggccaggatggtctcgatctcttgacgtcgtgatctgcccgcctcggcctcccaaagtgttgggattataggtgtgagccaccatgcctggcccaacattgatgagttttcacaactcatcatgtgatgtgattaaggaagcattgaaagcacagtttaaaaagccttaattgctgagatgatttcatgattattgttgtttctttagaaaccttgacatctcagcatatctaggacttttcttctctcaatatcttgaagagctaatttcgtttgcccccgtttttaggtttccacttcctatttttatgttgcgtatctgagattattatacaatgccccgtattttagggttcctacaaaagatagtaatgctgttgcttaagcagaaagtaatattgattctgactacgtggaaagtggggtggtaggtgaagtgaggaacacacaaagatataaaaccatgatgttataataataataatactgcataacatttggggaatagcaaataaataggatagaaaatacaattctgtaggagtttggagctgtgattggattttagaggagctagatggaagagttgaaaggacctctaactccaaaactgagtaatgaaattgatggtgtattatcaaggagcttcaggtaaatcatgcagccaatgaagagccttttctacctctccaactagtgtttctgtggcattgctttagcataattcattgtcatcagtaatgggaacaatcataaggaatttttgaagctgaatcttttaaaaagtaattgtgttaataaaaattttagttgctttatagtttttgcaacagataatggtggaatgtttaggaactgtggtgggtatattttctgtttcttaaaagttgaacaattccgttcttttattttctagttccattgctctcttatttgaacaggattttaagtttgtttaaaatacataaatgtggctgggcacaggggctcatgcatgtaatcccagcactttgggagggcaaggtagggggattgcttgagcccgagagtttgagaccagactgggcaacatagtaaggccacatctctacaaaaagtaaaaaaaaataaccaggcatggtggtgcatatctgaggtcccagctacttgggaaactgaggtgggaggattgcttgagcctgggaggttgaagctagagtgaaccgtgattataccactgcacaccagcctgggtgacagagtgagaccctgtctcaaattgtgtatgtgtgtgtgtgtgcatgtatgtgtgtgtgtgtgtgtgtgtgtgtgtataaatatataaatgtaacaaaacaaaaataagagaagaaaacattgggtcaggtgtggtggttcacacctgtaattccagcactttaggaggcctaagtgggtggattgcttgagctcaggaggaggatcgcttgagctcaggaggtggaggtcgcaataagctgtgattgcgctactgcactccagcctggatgacacaatgagaccaccctgtctctctgactctctctctctctctctctctctgtctctcccacacacacacacacacacacacacacacacacacaaaaagaaaaaaagaaaaagtagcataaattaaagatgaagttctacatagaatccaggtgctaaggtactatccattttgtataaataaatgacccacatacttgtctcttgagttttctgttagccacacaaaagagtgaacggtaggaggtttataagattggcactgtctgtagtataaaaacaaaccagctactcagaaagagcacaacccttcctaataccaactctaggcagaaataaatcttttctgtaggttctctgagagaagccccatagaatgtaatgagtaatgaatatccttaaaaacatccttacaagtagatagagaaaacttgttttagtactttaaaaatacatgtttataatgctttgggttaattgcataatgcctaagcatcatccagaaaaaacttttacagaggtcaaaaaaatgtgcactagacacaaactgtaagggagggacttagagccgggccagtcagtgtcagttcacactgcagcatcatctgtggcctcgttagaaaggcagactctccaaccccatctcagacccactgaatcataaccttcaaggcactgttgagaagcacatattaaagtatctaagttgacttaaaagacagttagataagccttcatgaatcatatttcccttaactgagtttagataaacattatggagcagtaaatttggagatttttctttgtgaaaaggaaatgaaataaatataaattcttttactggttaagcgtagatctattgcttttgcctttacccaaacattgggaagggtgttagacattcagttactatctaatatgggtgaagcactgggttaaatgagagatgtaaagatgaacaagacagacatggtaactgtttcttttatttattttttatttcagtaggcttttggggaaccggtggtgtttggttaaacgaatactgttctttagtggtgatttctgagattttgttgcatccattaccccaagcaatgtacactgtacccagtgtgtagtcttttgtcccttaccccagtcccaccctttttcccaagtccccagagtccattagcaggggcaatttagttgtaaacaagttgagggaaggaaactgcaaggtataaacaaagtgctgtgatggttatttctattctctagattttatacagaagaagaaactagctcagagaaataacttggtttagattacacagctaatatgttacaaagttaagaattgaactcaaggtctatgtgatactaaattcagtttacacttctgaaatatagcttcttgaaagaaaagaaagggaaaactattcagaaagtgagaaaaatcatactataaatcagtagcttctctattcaactccagtattttagacaatgtaataattttgaattacatctcctggagcaagtgctgtttttagttaatataaactgaggtgactcttgcagttttcctcaggaggtaataataaagtagggattcttcttctcctttttttttttttttttttttttttttttttttttttaaacagggtctcactctgtcgtccaggctggagtgcagtggcatgatcttggctccctgcaacctccgcctcctgggttcaagcacttctcctgcctcagcctccccagtagctgggattacagacatgcgccaccatgcccagctaatttttgtatttttagtagagatggggtttcaccatgttggccaggctggcttgaactcctggcctcaagtgatccacctgccttggcctcccaaagtgctgggattacaggtgtgagtcacagtgcccagccaagggattaaattttgccaaaataaacagtgccatgattgcagtcccctgccaccccccaataaaagtaagattttattgatatatgaagacaagcctgttttttcttttttgaaacaggatcttgctctttcccccaggctagagtgcagtggtgcagtctcagctcacagcaacctctgcctcccaggctccagagatcctcccacctcagcctcctgagtagctgggactacaggtgtgcaccatcatgcctggctaatttttagtatttttttgtagagatagaatctcaccatgttacccagactggtttcaaattgctggactcaagggattcacctacctcagcctcccaaagtactgagattacaggcgtgagccatcatgcccggccaacaagccagttttatcctcaagtgttgtgtgaggattcatgaagtgtttagcacacagcaggttttcaataaatattgattgaggaaaagaatttaatatttaccctttagatcacctttcgagcccacttttattgggtaataaaagagtagaatgaaaggaatatatttagaattttaaaaatcttacctcttttagaaacattttatagtataccagtcgtcatgacaatatgtgaactccccatcactatgtacttcatacttcagttggcattggccacagtttcccccatatcatactgatatgtatatttgtcttatattcccacaatagtatgagccttttagagagatctttatatttttctttcctatatgggctactgttaggtgtgtgtactcagaagatggtcattaagtatttaaatgaagaatgaatgatgatcactacaattattttaagtcaaatctgatctagcaacctgtgcctttatagtgagttcccaatggctgccttttaaacctggtcaaagccttgctagtcaaagatgatctatgaccatgcttctgagtatttttagtattgctgttgagagggctagcatttacggggtgctaattctgtgacagacacttttttttgtttttttttttgttttttttttttttgagatggagtgaactctgtcgcccaggctggagtgcagtggcacgatctcagctcactgcaagctccaccacctggattcatgccattctcctgcctcagccttccgagtagctgggactacaggcgcccgccaccatgcccagctaattttttgtgttttttagtagagacggggtttcaccgtgttagccaggatggtctcgatctcctgacctcatgatctgcccgcctcagcctcccaaagtgccgggattgcaggcatgagccaccgcgcccggccaacagacactatttaaaacattatttcctttagtcagtacaacagtcctaggaactcttactgtctgtagtggagatagggaaacaggtttataaggaattaataatttattgctcaagagtaagagtaaatgaataactaggagataatgaatgtcctggccatttattctcaaagagcatgaatatacagaataggctgatttgagacattatactgctttcttcctggaaactgactttggtggaatggtcaagctcttactttagaagtcataaagagctgtgtatggagaaggtaacagtcggtatgttaaaacaacagatccggccatagaataggtgcctaatggttctgaaatataagcaaacatgctggacaactttatcattatttctggcatggctggctctggggctcatgtttgtaatcccaactctctgggaggccgaggcagggagattgcttgagcctaggagtttgagaccagcccgggcaacataacgaaaccatgtctttacaaaaaattaaaaaaaaaaattgggtgtgcatggtgatgcaggcctatagtcccagcagctcaggaggttgaggtgagaggattggttgagcctggaagttcgaggttgcagtgagccatgatcatgtcactgcactccagcctgtgtggcagagcaagaccctgtctccaaaataaaaaataaaataaaataaaacatagttgtttctgacttagcagaatgtgttatattggaaactctatgcttctgtgaatccagtactgcaactctctcccactcatttaagaataaatccttaagaatcccaagaaataaacatataccacagttcagtccattgggccagtatatttataggatagtcacacaagtccagaaactgtcaggctgttactctgtgagaataatgggaagggttcttatcttcattcccactccaaagtaaggtttactttctagaagtgagatgcaatataaagtacccacgcaaaaggtttgaggcttatgcagaaaacaagcatggattaggatagttagggtttcatggagcatactttttccattaacaccaagaagataaatttagttgtctttttctgctagagctttgtggaatggagttagtgaagtaaaaggcatattccctttgtttttgttgcagaaataaatgggcaaggacactttaaagatttcgtgtgtgcattgtggctacttgtcctaaacataaaatcatacaactaaatgaaaatctctctttcaattcattttaacatagtgatttgctgcttattagtgcaatctggcaaaaaatgttagccaagcagctaatattttgtttacatttttgccctagcaaagatatatcaaatcccctgatgtacacctcttactcaggtattattgtaaaaatcaacaaggaccatttgaacactgataatactaaaaactgtcggttcccttattgtttctttaaaaataaaaccaaaacaaagcaattaactgcaaagggctatagtaacccaaagcaaagtttacatatttaaacataggggagtaaggaagtacagaagttaaacaacaagagagataatcttgaaagtggcaaaagtgacttatctcacttaaaagagtctcaataaggctgacagctgatttctcttcagagaccatggaggttagaagacagtggcatgacatattcaaagtgatgaaggaaaggctatcaagcaaaagttctatctgtagaaaaactcctccaatttttaaggagaaattaaggcatttccagataaacataacctgagagaattttccactagtagacctgttctacaagaaataccaatggaagtccttcaggctgaaataaaagggtattagatcacaattcaaatccacatgaagaaataacactaataaggtaactgcataggtaaatataaaagacagtataactgtatttttgtttgtaacattttttcttctgtctgatttaaaatacaatgacattaaagcaataacgataaaactatgtgtttggctaatagtgtattcagaagtaatttgtgtaacaataacacaaagaagagggtagagaacagagctatttagaagcaagattttatatactattgaaattaacttggtattaattctacctacattgttataaattgagataatattaatcaccagggattaagaaaacaactaaaatgcatactaatagaaataacaagggaattaaaatgatacattataaaatacagattttttataaaagaaggcaataatagagaaagagaggacaaaaagacagcatatagaaaacaaataacaaaatggtagacataaatcctaccttatgagtaatttatttaatgtaaatgtattaaatagtccaataaaaaaagcagatgttgaaagaatggataagaaaatattatctatttgtattctctatgtaagagacacatatgagattcagagacacaaattagtaaaagaatgtagaaagtaaaagaatggaggaagatatgccatgcaaacagtgactgaaagagagctgactacactaatatcagtatgttgtgtgtcagacccaatagattttttttaaataataaaaccgcatttttatgttacaagaagattttatataatatctgcatgatataccaattttctcataatctcttctgtaatattatttcattaacactctggtccacagcttgattcaacaagatcaggagggcaggcaggaggatgttaaaagaaaggtactgaggtgtaaaaggaaccaaacatttactgactcaggcacctattcttgatttctgttcacctgttgccttgaacaaactgcctgagctcatatgccttacctccataaggagcatgacctttgggaatttaccaggtcctcatccctgtggactcagaatcttgcttggtaagagtttataattgactttttttttttttgagaccgagtcttgctctgtcacctaggctggagtgcagtggtgtgatctcagctcactgcaacctccacctcccaagccccagcaattctcatgccccagcctcccaagtagctgtaactacagacatgtgccatcacacctggctaatttttgtaatttttctgtttttaagtagagatggggtttcgccatgttcaccagtctggtcttgaacccctggcctgaagtgattgacctgtctcagtctcccaaagtgctgggattacaggtgtaagccaccacgtgggcctggctgacacaatagattttaaaggacaataattttactacagacaaaaaaggacatgttgcaatgataaaaggctcaaaccatgaagaagacataggaattgtaaacatttatgcacccaaaatgtatgacacaaaattgacagaataaaatggagaaatagaaaatttaacaataatagttggggacttcactactccactttacataatggacagaacatccacaaggaaatagaagacatgaacaacactgaaaactaggcctaataggcatttccacccaacaacagtggaatacatattcttctcagtgctcaaggactattccaggctaagccatatttgctaggccataaaataagtttcaggaaaatttaaaggaccaacagcatgcaaagtatattctccaactacaatggaatgaaattagaaattaaaaaaaataagaatttagtaaattctcaaatatatgggaattaaacaatatactcccaaataaccaataggtcaaagaacaaagcagggtaaacatacatgtatatccatattaatgaattaatttaaagaatttttagtcacattatggcttaaaaataatttttcagtattgtccaaataaagtacctcattgccatgatgaaattggatacgggagatgttagcttgctaaaaatgacatataattattatgtaagagggacattaaaaggctaacaattaattttgaaggattaacattcttattttagaaaggatgactcctgttaagacattcttgcctatgcatacctgctgtttggattttctttctaatggaatagactagtttatattactatctatcttattgacatctcaaagcccttggtttaaattgatggttcagttagacaaaatcttaacttacaaggaaaagttgtttatgcaagtgaatttagaaatttagctatctatacttttaaaaacattggcagtatatctcagtggtatgagatagtccacatctttttatggactttttgttttattataggctttagtgccattaagggaaaactatttagttactctaggaatagccaaacattgttcccagaaatgcttgtgttatgtctgtcatggtacattgttaagttcagagcacatgtgtttaggagtctcaatgctggctgaagaatggaaaggacttttattacaaatagtggattttatttaattttgaatttatattaaatgatgaaaaaataggtcctgcaataatttagagaaaacctgtctcttcagggcaaggacaaatcaatattgagtgtttcaattgaattgatgcactttcaattataataatcttcatggtagttgaaaggcaggcccaagcaaaaatcatgatatgcacaaaaatattgctggaagcactatctgctattagctatctgctcatgctgtttaccttcacggaatttctaggttcaaaatcagccatttatttagaacgccagagtacccaccaaggaagcatattgtatagttttgttctgacgaagcatgtggctagaaaacaccagaaattagagttggggttacaaagagtctatgcacatttcttaagtctgagaggtttttttccttatgataattcagtagattcctataaatgactctttagtcacaagtttttttcatttagaagaaaattaaaggtatttaaataaataaataaataacatgcccattacatgttaacatgagaaacttttttaatgaaagataaacatattttcgaaaaaaatttaggagagtagcagtgtttgcattgttgcaaatagctttgatatttaacttaatacaagacagctggattttcatatctgcttctgcatgcaatctgtagcaatatgtgtttcaggttgagaatatgtggaaaatttggccttccacagataatattgctcaaagaggaagaagtattttaagaatctttgcagacaattatggagattattctataataccacaccgaaacttcaaaagtagtagttttctaaaggttggtcgcaatgtagaagctgacaccatatcaataatttttaatactcttattacattaaaatttgttggtctatcttgcactttgaatgggctttttaaccatgcttgatattgcatcactcactggtcatttggaaaaaatgtgtgtcactaaattatacagattttccaaatgctgacacacttcattgtacattatctaacaaaacactttcattaattacaccatttatctcattagaaaattctaagtattgacaagatatcatggtggccaacgcacaatttcaaaaatttaaagttttccttgaaagttctaattttattagcaacaattactctcagttattttccttaccgtgacaggcactttgggttcatttttgataagttataggccaaatactcaggtctgaataatcagttaattgaatcattcaagtaaaaatgttttttctgtttttaagaaaacagctagtttggcttgcaactcaaacaattgcacaagtacctttcctcaggacagacattgtgcatctgtatgcagcaggaaggctttatgtgcacgtcccatctcatcacacagaatattaaaaagatgcatgcccaacagttgacattcaataaaattaattttttcctgtttcatcaagaatattagtaaataaaatatatgttgtaggttttttcctaaaggtgggggtacagttttaagggatacaatgactgtaaatacactgtgataccactgccttgattgttgataattgacagcagcagttttacctgccatcacttctgtaccatcggtgcaaatatcaacacagtgagaaaacatataacatcttagtcttcttatgaaagtcattttgatgcccaagagcccatgtgccatgctttttgagaactagtgctttatttatatttatgatggagccatccaattttagagatgcaaaaacattaggtacataggttttaagaattttcaaactgagaaaaaaaaattacaaaaatcacatatttaggttttaacctgacttctgtgctgttcagctgtgaaaataaaaccatgttattaatataaattgtgaggggaccagtctacagcttctgtactccaaagtacattttgctaaatcaaggtcatatctaaaagacatggctttattatgatagtgtagtttagaaacattaaaacttatttctaaatttattttaattgactttataatgtataatatgttgttttgaaacatgtatacattgtggtgcagctaagttgagataattaatttatgcattatctttcatactactttttttgtggcgagaacacttaggaatatttctcttgcaatattcaatactacaatgcatttttattagctatagtcaccatgacgtacaatagatctcttgaacttattcctcctatctaaccgaaactttatatcttttgaccaagagctccccagtctcttccccacaacactgttattagtacctacccttctactctctacttctatgagagtaatttttatagaattctacctataagtgagatcatgcagtatttgtctttctgtgcctggctgatttcactgaacgtaatgccatctagttttgtccatgttgttgaaaatgacaggatttccttttatttgttaaggctgaaaggtattccgtgtatatgtatacatcacattttctttattctttctttattgatggacacttagtttcatttcatactttggctgttgtgaataatgctgcagtgaacatggcagtgcagatatctctttgacatatttacttcatttccttttgatacatacccagtagtgggattgctagatctcgactggaaatattttgtgcttctgcttctgtccttacatagctgtttatgatagacaataaatattaggcagatacctaaacactcttaaaataccaacaaaaaaacctgtgacaccattcttatagtatttccaattttactctttctttacatagtacttgatagaatgctgagcaccctgacttaacacaatcttaattgatgttggtgctactcagttattggaataatttaaaatgtgcctttcttgatcaattagtattttcattacagctcacttatttaattgatctaatgaaacactaagcctattagaatgtgaagaaatcaaagagaaatgtagaaaatattttataaaattcatctaacatatccactgtgctgtgtattttgcagctattttcaaaaagtttatgtccatgtccatgttttattgacacacatacagtcgatacatacattgcttgagatgatagtttctttgatggctatatcttatttctcatatacctgtaatatttagcacatagaatttgcatgaccaaagtttgttattagtttgaattttaaattttactttatgggcataagtttatgaactcatttccagctgagtttaagagttttcaagtgccagagaggttgcaagaaccaaattaaaaaaaaaaaagttgttgctgaaaattctctcttaggctcaagagcctcaattttcaaatgtggttgattttaattaaagtttaaagagaaaaagaaactattggaaagatattggaactaaataattcacttgtagtgaatagggagtttgtggtttgagttaatagtattcattacactgattaaaggcagtgagccattttgcccttgtttattttccaagccagtgtttccagtaatggggggtggctggtatttgatgttttatgtaatgaggtatttactgatgggctactttgacttctctacttaaatggataaccacttgaaaggaactgatcagaagaacagtttcttttctagagctggaccatttattccaaactcagacagtaagaaaacaattgaatagcttttattgccaccagctgtgctgtggttatttgaacaaatggaagactaaagtaatggtacaatctcattttatacagcattacacaaaatcaggattcttttgcctaataaatattgcatttatagttacttagatttccatcattatgatgagtttgctgccctttgagggttaataagtgggtctatcaaagttaagtcttctggaagttcagggaatgtgctgcttcagggcttatagcaaattcatgattatttgttttgcagatatacacacatatatacatacacatatatggaatatgtaacgtggaatatatataaataaaactctaaactttgaaaaattatagttcctcaaccaggaattctagtgatttgtatcacttggctactctagggctttggaaaaaatgagaagtgggtgtttaaatgttttaagaggtaattttccaagcaattgagcaggtagttaaaaataccttgttttcatttccttgcctgagaaaatcctaaagtctaaaggtttaaaagagagtagaaggaactacactgaattgggcctgaagtgtatgcaccagaaaagaagaccttcaccactcaccagtctccagagtttactgatcagtatatgaagtcattgtgttcgaaatatgagcatgggaagctgggcatggtggtgtgtgcctatagtcccagctactcaggaggctgaggtgggaggattgcttgagccctggagttggaggttggagtgagtcatgattgtgccactgcactttagcctgggcaacagagggagaccttgtctaatacacatatatatacgtatatatacatatatacacatatatatatatacacacacatatatatgcatgggaaccaggattgcctcctcctagttgggctgcctaaatatgtagttgcatggtgattgttggtgtgccttttgattcttataacttattaagtgttatcattgaggtgaaaagatctcttgagtttgatagagataagcagtccacacaaaagggctagacaggggtttctcaacctcagcactactgatatattgggctggataattctttgttgtaggggcctgttgtgttcgttataggaggtacagtcatatccctggcttctatctactggcacactcagcccacattgtgacaaccaaaaatgtctttaggcattgctagatgtccccctgggttggggcactgtgtagtggcagaatggtccttgttgaaatccactgtaatagacagtgaactcctagcaagtggtattggttctcggtcatctgtgtatcctcagtgggatatcttgaaagggcctggcatggagttgcttctcaataaatgtttgtagaaattaaacaaaaaaaaaactgtgacttagaaaagaaaggggatttcttttcctgttaccttctctgccactgatttcctgttattggtagaacaggcatagaataaaaaagttcaatgctacattacttataaaaagcaaaagctcagaaaaacttctggatgcttaataatatagaaaaggccaagtacattggtactttcctttgtgggatatggtacatttcttttgtgggatactaccttcataaaacaggttgtctatcaaaagtttaaacgttattttttctgtaaaaagttaggctataaacttacataatcatctgtttttaatatgtatgtatgtgtatacatacgtagtatattatttcttggtgaaaaaagagtaggaggaaaaatgctaaattattagtcatggttgcttttggtagtatgattacattttatgtgcaccttctgactaattattgagaagatgccttctttttctttggtcttctgacaagctaaataaaaccaatagaaaaccagccaagtctgagtgaattttatatcatcattggaaatggattttttcattttttaatgaaaagaaaaataaataacaagttaacaaaattttccctttaattttattattcgattctgtgtaacattgttaatttgcaaaaataaatttagcattaaaattgattctgtgtgctaaacatagcctggaaaaaatgctcagggtatttagtaactactatatggaagtttcttaaaaggtagaagaaataatttctacaaagtttgtctgtattgcaaacattgcagtgtaatattgattgtttttcactattattccttgtgattatctcatggtaatgctttcttgtagaacgtgtaattggggaagaaaacatagatgttgcaagtgtacagtgtgattttaaaagaattacctgttttcaattagagagataatgtggctatatacctgtatgtatatatactctatgtattgatttgtgtattgaagtgagattgtaccggagctttttgtgaaatactcccagctgtcttgcctaagcacacattagatacatacattttagaaggatccataacttagaacattagtggttcccagttttcctcctcaccatggtgttggactgaacagcccaagtggtatatgtattcagcctgccatatgtttcagtaagagcaaacatctggtaccagtttcccccttgcttttcttgatccagctgtatagactaactttgaatcttagaaatgctgcagtcttccatttcatgcatccctcagcatgaagcacattttttttcacccgaattcctacatttttattaagccttagtttgaaagcacttcttcaagatgggcatttcgtgatgccttcttccttggatgctaagttgtgctcctgacaccccatgcttcctttgcagcagcattttaatacaggatggagaaccctcctttgatacctgccttctgcaggaatctataagcttctgtgaaggcaaaaatcagtcacgtcctgttcaccacagtatctcaggcatctaacaaagtgcccagaacattgatagcatttagtaaatgatgaatgaatgcatccataaatgaaggaaggaatctgttccaacatctttgagaggaaagagtcagaagcatcaaaaattaattctcaaataatagagattagtacaatatttgttgaacaataacagccattgaaagcgcattcatcaccaatgtactgatttggaaatgtgaagttttggaaatgtgaattttagtaatatcatagattattatggaatggcagtatttcaaatgtttatgttttacaggatgagtgctaactctaccagcaattatagtattaacagtttcatcaaatattttccttgtttctgaatcttaccagttgtgcataggtgctttcctatttgaaagcagcgcatcattcagcctcctgaatgtatttagaccttgtaagtataattaactctttcttgacgggggcatatttaagattttttaaaaaatacatatatagtgtgttgcagcaaaacctttctaagaaggagtcagtaggatgtagggataatttttttctacaataaatatttccagaccctttatttataatcaatatatgaataaggaccactaaatttaaaatgtttaatgagatgtgtatagaaggatcaaaaagatatatttccacagttacaaaatgcaatggaagctgtctctaacactagctatcgaaataaaagaaacctcgaagtaggcctaatcaaagattcaaaatatgttcatgtacaaaaatgatttttaatgaaagtcatttaagaagatttaaatcaatggagaaatactatttttatggattggataagtcaatgttataaatttgctaattcttttcaaattgaggtatgggttcagtaaaattctaatcaagaccttaacaaatttttaaatagaatttgacaagctaattctcagatttatctggaagagtaaaggtcaggaaagaaaagacaaatttgaggagaaagaataaagtgggaagaatggcattataagataactagactactgctactactactactactactactactactactactactactactactactactatttcttcctcctctttctcctcctcctcctcttcttcttcttcttcctcctcctcctcctcttcctcttccccttcttccccttcttcgtttttttttttttttttttttttttttgaacaagacaggatgtctgttgccctcgctggagtgcagtgacatcataactcactgcagcatcaaactcgtggacttaagctagccatcctcccacctcagcctcctgagtagctaggactacaggcatgccacaccatgcctggctaattgttaaactttttttgtagatttagggtctcccttttttgcccaggctggtcccgaactcctggcttcaggtgattctccctccttggcctcccaaagtgctgggagtacaggtgtgaaccactgcagccagcctagacttcttataaagccataaggtatattgtgtatagcaaaatagaccagactggagagccagaaaggactaatttacacataatatatacatatctgaaagaggtgtcattgttgatcagtgggaaagggatgagtcacttagtaaatggtgctgggacaaaagtttgaaattgtatctttacctcatgaaagcacaaaagcaattccagataaattacaaattaaaattggaaatggaaattggaggatatttgtgtgatatagggaaggacagtagtttataaacaacattttaaaaagcactaatctcaaaggaagggattataattatgaataaaaatgatgaacattaaatataacaaagaattagcattcagaataccaaaaataatataagtaacacagtggaagacgggacaaataagaatagttaatcctaaaatgaaacccaaatgtctactaagcagccaagacaaggattagggaaatgcaaatcaaaactacactgttatacaattttacgcatctatcatattgacaaaattgtgaagttcaatgtcaccaggtgttagtgaagatacggagcagtaggaaatttcataattctgaggaatgtaaattggtgacacctgggagaaaatttcacctatatatgtagtaaagtttcatattttataaggacccagaaattctatgggaagtataatccctagggataccttctcatatgtatacaaagggacatgtacaggaatatttattcgggattgttcataatattaaaaaaatagaatcaaagtgaatagccattctattagttcattttgtgttgctctaacagattacctgaggctggataatttatttttaaaaatagttttatttggctctcaattcaagtggctggaaaattgtctgcatctggtgaggtcctcatgctgcttcaactcatggtggaaaatagaaggtaagcaggcatgtgcatagatcacatggtgagagagaatgcaagagagcaaatcagaggaagccaagctctttttaacaacctgctctcaggggaatgaatccattcttgaaaggccaagaactcactcacccccaagagaaggcattaatctattcatgaaggatccacccctatggcctaaacaccttccaataggccctacctcccaacactgccacatcagagaccaaatttcaatatgagtttgggtggggacaaaccacatcccaactatagcagccatcagtaggaaaatggataaataatttgagatatttttatgcaatggaatattatgtcggtctgagaaagaatgaactagggattgacatattgtcatggacaaatctcaaaaatatgtttaggaaaaataagttgcagaaaattattatactttatcatttatataaagctgaaactatgcataacactgctatatattctttaaggttatgtacatatgaaataaaacacaaagacatgcttcagaatgataaattcagaatttcagaacagattatttgtggggagggatgcaatgaagcttcaagtctatttgtaatatatttcttagggatgggggctgtgaatgccatttacgtgacagtagccccaaatttgtatgtctagcccaggcagctttcctgaacttcaggcatgtatatccagatgatctggtagccttctagaatggccagactgaattgctagcatttcagcaaaattgctctacacacagtgtttcccatatcaattaatgacacttacttctaattgctcaggccagaaatttttgaaaaatcattgaatgttgtcttttcctcatgccctaaattcagtcagaaactcctcttgtctgtaccttcaatacataaggagaggcctgttattccttctcactttacagctaccctcacagatctatatcaccacaatcttttgcttagattttcaaaatagcttcctaattggcctctcagctttcaccccagaaactcttcccagccccaccgtttattcttaacacagctgccagaatggtcctgttaagtatgaatcatgttgtattactctttttctcaaagcccagcagtggctccctatttctcttccagaaaaagccaaagtcttaaaaggcctcaaaggcgctgtgtggtatggtccttgccatctgtctcacttcattcttttaactctccccttcgttgaattgctgtggttgcaagagcctccttgatgttcactggacctgcctcaagtgctcccaccagacatattttatccttgagcttttctctcaatctgcatggtcaagtacctttatgggtttgtttacgtggcctttcccttcctcgggtgttttctcagaagtcaccataccactgagcccttcactagccactctatttaagattgtaacactctcattccatgcttcgtttttgtttatagcacttcctattttctaacatacctgtcatttacctctgtttagtgtacactctttattgtctgcttcccatgataaaacataaagtttgcaaaagccaggatttttgtctgtcttatccacaggcatatccccagcaccttgaagagtacaggtatagtagactctcggtaaacatatgtttaataaatgattgaatgaatatgcacttgtttgttatgttattctgtgtatctataatgtaacaatttaaagaaagcacctggttgagaaagatgccatggttcagtggtagatactaaaaataattgcaatcatagtatacatttttatcagattttatatctattcttatactatagcttgactccatttttaacctgtatgaaactaggaatggaattaatggtaggccaggtgtgcacattgaataggtagctcagagtaatgaaggaaaaggcaagaaagagctttcccaagagcaagtgtggtattgatacagtatttcctttataataccctttaaactcttatatggaaccttagaaaaacacaaaacctcctattttctacaaatacttcagaatgtcttgcctaatgcattcagtttgtgtcagcttcttgatattattttaacacatctttctgtaattgttttttaagtgtggcactcgagttttcaggagtgttctgagctgtgattgatcatcatacatgcattttgaatagggacatctgtctctgcagcatattatgtctcctgacatgccatttctcagcttgacagagcacctctagagggcataggctttaataagatagaatatgtgacttttttttacttccatagacagtgagtggtgttacattttataatgaaataatgaatagctgaagtgacagcttacccaatttgcctttcttcgtgagccaaatataaaactagaaataaagcttattcattttagcctgtctaatatttacttcaaaaacattttaataggacaatatttactaaataagttttcttgtattcatagttgacagtgacaaaaatggcttctttgtctttttctcctaaatttttctctttttatccttatcattttttctatacctaaatttttcttgcatccttttatatgagcaaattgcctctaatcttgaaacatatagtttattaatttgatttgaaatttattttgatgttatttttaccagtcattcagtaatcatagatagttacattgttaaaaaaacaaaacaaaacaaaaaacaaaaaaacaggcacaaagctagatgaatgagcgttgtgtggactctgccctagaggagacccaagtttagtgtgagaaggagataggaaacaatgataaagtttgtgcactccagaagaagtaggagcgatcgcctgcggcactgaagaaacagtggcaggctctgcttggatggaggacactggccaagtggtcaagctggcagagaaggcaactgatccatgtcttaaaaagtgcatgtgcctttaccagcaaaaaggagacgagatggggcagacaagcagagcagcaggtgcaaattggaagagtggaaggttttggcctgttgaaagaaagatgaaaattacttgtacctggagtagtaggtgtgcaaggtgggaggaggaggatgacagatgaagctggagaagtaaatttttatttatacgtagaacttatagttcttttcttccattttgatattgtctgcctgactcaagtatcttattttacacccacaactgcaaatatctcccgtcatttgaaagaagacttactggaagtcattttcctacctcattttctcatttcctgacaacttctttcgactgtcttgattaatttccaaatatgggaatattttcaggtcccatggtcaaagattttattaaaaagtcttacctctgattcagctaaatggttagtcaatttactaattaataggaaatgctttgtagttataggtaattaacatgttaatagtttaaataaaattgattgattcttctctttgcttggttaatttaactatcccagagatcaagttttaaaaaaacttgttatcgtttagctttatgcaactaattaccgttagtcctttaccatgtctatgtcattgcacttgcttcttcagctagtgacatcagaaccttcacttcactagcaacatcgtacaaacaagaggaagcaccatcttgaacttccacaggaatctcttcctttcggaagtattttaatcattacttcaccagctatgttccacttctggatattttggtaaattttccgagcatttagaagccacatatcactcctttcagttgcaggaaattggccttttatatcagaacactgtgatctgtgaaatgggtactcagtgactttagaacacgtcaagagattagcttcgtgtctagagtctgcctaaacagttccaaggtgagatttgttatttcacatttagcaatgatttaaaaacaaaaacatacgctttgaatggagtgctttattaaaataatggaagaacatggtagaggaagaactccctgggaagagtttaaatagtataaatagctttgctgagagagcaacaaagttctgtattgtgctgttgccacagcagcaccaataattcaaaacaaggaaatggagtctcatatttaatataatacagacttttccctagaacttctgtggtctagggtttttcagggattggcatgtttacatatgtctaaatttagacatgccttttatgtaatatgatgaaagagaagtacttaaaattctatatgatgcagttatttcttaaactttttttttgttttaaattgactaaaatatcaggaattttctgtgctgaagtcaatgccccaggacattgtgaatttatgcatatgaagggagacataatctcttatgcaccccacatttgattttaaaagatcactttgaaaagtatgaagaggtgtttagtaattcaaggaagaaaaataatttcttttctattgaatattctattgaacattctataacaagagttttctctgctgtggaagtaggtactctgttctgaaagtcaggatctggaaattcagaaacacagatacggacgtttggggaattttaaagtaaattttatatgtcattttggaaataaattagaaagatatcggaccaatctcaggcgtggacagaattcaattcatcattcaataaagtacaactaaatctctaccaaataacaaaatccagtcataataaaagctcgcttacgaagaaatgtttgactgtagcaaactgctttttattaaacgtacttgacacaacacaaggagatggcagtgtgctttccgactttcagatttttgttgtcccaatgttagttcatctcacagcctgcctggcttttccaccaccaattttatccttgttcttactaaagagtaaatttgtaggcaagtttgattgttatgagataagaataaatgaaatggttagggaaattttcatattttgatcttttctacccagtgacatcatgatgaagatgatgcaaaaaattggtcagatatatatctagtatgaatgtgtgtttgtatttactttttttttgaggcaaagtctcactcttgttgcccaggctggagtgcgcagtggcgtgatctcagctcactgcaacctctgcctcccgggttcaagcgattctcctgcctcagcctcctgagtagctgggactacaggcgcccgccaccacagctggctaatttttgtatttttagtagagatgggatttcaccatgttggccaggctggtcttaaactcctgacctcgtgatccacccccctcgaccccccaaagtactgggattacagggtgagagccaccatgcccagccacatttactcatttaataaggacaaatattgcctagaaactagtttcaaagaggcctgattcattttttatgtaaattgaccaaatattatttcttgcatgaaagctttattaaggaattatgatgtaatttttcatttatctcttctggctagtgtcgaaaggggaattctgagtgttgaaaggggaattcttagagatgtaaaaaaataactgaattacccttaaaaagattgaaaagttaaaaagcaaataaaaagaaaatgaaaatatacttatccatttagcaaatatttaaggacctacgtcagttatgtttctaggcactggaaataaaatgaatattgaaaaagacaggataggttcgtgagacttatgtataatcaatatttaaagagggaatttgggccaggcacagtggctcacccatgtaatccgagcagtttgggaggccaaggcggaaggattgcttgagcttaggagtttgagaccagcttggataacatagtgtgactccatctctacaaaaaagttaaaaattagcagctgggtgcagtagctcatgcctgtgatcccagcactttgggaggcccaggtgggcgcatcatgaggtcaggggttcgagaacagcctgaccaacatggtgaaaccccatctctactaaaaatacaaaaattagctgggcatgatggtgtgtgcctgtaatcccagctactcaggaggctgaggcaggagaatcactggaacctgggaggcggaggttgcattgagccaagatcgctccattgcactccagcctgggtgacagagcgagactctgtctcaaaaaaaaaaaacaaaaaacaaaaaaaatagctggcgtgttggcctgcacttatagtcccagctactcaggaggctgagacaggaggatagcctgagcccaggaggtcaaggtgacagtgagccatgattgttccactgtattccagcctgggtgacagaatgagaccctgtctcaaaaaaaataaataaataaataaaaaagaggggatttggataataaaataacttattgagatggtctaatattgttatgacttcttcttccatttaatcatttatttaggcattatttatcatgagcacatcaacatttgtatctgcccttttcttctttgttcgcttaatgttatcttttccagtttctcagaaggaaaaagaattaaatgaacctcacatgtgatttgaaaacagagatagtatccattccaggcctctgttttattttgctcttcccctctccttgacactttacttttgggcagatgtgcctgaggaagacttagtgtaagatgacacaaggtggaacagagcttagtttgtgagtctgagaagacttagtctaagatgatacaaggtggaacaaagcttagtttgtgagtctgaagcagaatcaggcagtgataagcagtgtgtttcctggaggatgataaactttctatatgatgaccttgttttatcgtggtattagtgagcatcaaaactattcactgacttatattcatatattttctcaagaggaggaaaatactgcatgggttttgcagccagtcttcctgttcagatttactctgcttaagtacttaatttaagagagagagagaggttgacaaaggattccgtaacttctagtcttcaaatgatcaaaactgaggacctggtgaaggtttcaggaaaccacttctttaattgattctctttccatgtaaaatgtatttcaaaggataatagcctacgatttgactccaaagcttcagcgtagaagaggaattcttctggctgaactatatagctaatgctcaattaccttagcttctattgaaccgtattctaaacaccttcctttgtaaccatcaccttgtgcagaagtctgtatttttagcctttaagcagagctcaagtgctgtatttagacatctgacttgaagactaaaatttgctcagtgagcagaacaaatgttcagaaaataacatttcaaggttagagttagtgtcctgaataaaatcccttttcttctttttctccgtattgaatataacataaataatgtaccctgactgacttttaagattaaaaatcagagaatacagtgaacttggaaagggaagagaacataattaaaaattgaaggggcttctgttgaacaattgtttgcctgaaactaagtacacgttttattcttgactcaataggattatggatcttaaaaggatttttaaaactatatagtaaagcgtttagaaaaagggcctgaataagcctgcagctactgtaagaaatattgaaagaaacacacacactcacagaatcatcataatatccttcttagtatgaggaggaaaaaactaaatactgtttattgctagtagttacagtaattgtatttaccaggttttgactgtctacaatgtgttagtcactgtgcaaggccctatatataataaaccttatttaatattcacagcaattctatggaataggtattataaatcccgttttgtaaatgagaaataaagtccagaaagtttaataacattcttaagattatatagttagtaaatggaagtatattgtgaatatttctcaagaaaatctcaaaatggtgcccaagactccctgtccttgagaaataaaaacattttacttcttaggggaaatagatgagagtgatacgttgtgattattattcttaaacaagacaatgcaaggtcccgggacccttttttgaaagggaaatgacatatttgcactgagggaaagtgattatcacttgctgagcatttccttaagaattctgctcacttggattatgtgtaatttggtgaagaatttatccccatgtattccatgaggcaaaaggatgttgcaattgaacttcacagtgcatccataccaatccaccgggggaaaaataataaatgagtctgggtactcccttctcttggccacatggttgatgttgtagtcttcactctatacagccagtcaccttgtgaacagaactagctagagcccaggactatttgattgattaaagattcccacccttaaaattaggactgaaagacatgttagaaattctgaatatgttttaggccctgcatttgaaaggtaataaatagggtatgtgaaactctttgacctttttctggttctcagtgccttgaaatttctatctcaattttgtagatactcaacactctaacccagcaaggggagatatttcatagtggggcatagtaataatataagaagagtgtattagtctgttttcacactgctagaaagaactacttgagactgggcaatttaggaagaaaagaggtttcattgactcacattctgaaggctcaacaggaagcgtgactgggaggcctcaggaaacttacaatcatggtggaaggcaaagaggaaacaggcagcttcttcacatggtggcaggagggagcaaagggggaagtgccacacactttcaaacaaccagatcttctgagaactcactcacaatcaagagaacagcttgggggaagtccacccccataatccaatcacctctcaccaggcccctccaccaatatgtgaggattacaatttgagatgagatttaggtggggacacagagccaaaccatatcaaagagactgagtaaagcaaaggtgaattagagatttattttaaatgtagtggaataccaagtttatgtaaagcagaaagtttaacagtggtatggctattatttggtgaactgattatcattcttttttgcataataggttgtgagtacccgtggcccaatggtatcttaattcttcatttgaaattctaaaggtttgcatttcatttttgttaagcatgttgcattactctaaaacagattttaaaagaaagatactgaaatataattccatatagttactgagtcattgactttttcagaactcttttaggtaatcacccttatttatagatgggaaacattcagctgcagaattaaatgatttgctcaaaaggaaacaggaataaatggcagaatcaaccacctaatactttggatttttggaaagtattaaaaataaacaaatcagaacaacaaagttctccatttctttgtttgtggagtattctcccctctggccccagcaaaagaaaaagttagaaaggagatcctctggaagttaaaccaatgtgtttaaggttaaaccctgcctcatgtcacttgtacaatttacacaacattcatttccttaagtgctaccataattttgtgaatgttaacataaagaagtccaggaggccaccaaattgttcccattggcttttttgtgtagtgtaggataatgaggcaatttttgctttgtctatatatattttgtgtattacttgattttatgatcatatattgtttgtgtgactttacctttaaagtcaatagaattataaatttaatttggtatttacaacacacatatgcacacacatatgtatatattttttcatcaaacattaggcaaatgatggttacatgaaacatgaaactctgggactacttctgtttcacaggttcagatcctgtgtcctgacttttggttgagaaaatataggctcagttaatgtattcagttgtgtgcttttacccaattttccattatctcctatttcatcttccaccaaagtaacttcagacaagaaaagtgtgtttgaagactaccacgggttaactgcctgtattccattataaaatctttgtatatcgtgttagtctttggttttgtggtcaggatcgactataatgaattctggttcttgatttaccaaatgtgagaacttggccgatttatctaatctttgggtaaattagtctccccatgtgtaaattaggaatgagaaaacttaacctttagggttgttgtgagaactaaaagagctccagtttgtccagtgcttggttttatagggactagatacaggtagatttctttcttcttcatttgatttaaatccaacactcactcttactgttgtcccaggtaaaattttaaaaattcattttgctataagtcagacatgattttcagcactctgatttaaaaagtaatgtgatttcttgtggaataactaaaataaggacccaatgacagttgtttccacattaaagttgggtggatttcacctaaagcttctgaattgccagacaagcttcactttatcaaggagaaaaattaaaatccactaaaccaaagtaaaatgaactaaaattccagaagctaaaggacaagtaaaggacacagtcttcacactctgggcttttcttttggtgttctttccattgactgtgggataaaatttgggggaaattgtgagggtgtgaatggcaagtgtatgtttgggttctaagacttgggtcattaataccaagtcataatgtatatttttctatcccctttcttactcagtattgttcattttttagtgttattcagtattttcagtatcatgatttgtagaaatttttataataatgacataattataccataatttcttttactattttccttatattgggaatatacaccatttgcagttattcagtgacactttaaagtagcagtgtgatggacattcatttacataaatcactatccacatccttgattttttttcttttgaaatgattcctagaaatagaatcactcttaaggagtgtgaacgttttaaaagattcttgatatagtgtgacatttttttccctgggaaaggtgtaccaatttacactcctaccagcagtgtttttcacatcatgtgcttgtcattatctattagcatcaatgatatatgaaaatgttaatgtttcataatttacatttacttgcttaccagtgaagttgagtgttatgtcttatgtttactagagaagacaggcacactggaatgctccttcttttcagcaagtacatatttagacactttgtgttccagtggtagtttttctcatttatttgaatatatgtcaataagcaaaatcttggctaaaaataatcaccttagcactaaatttagtcaagtgtcaaaggcattttaaagagactaaatttgggatgcatctcagaaaaacatactgcatgatactatgctaatgagattttctttttatgctgggcaactggtaattttgttgttcaccctgagttccccaacaatgttgaactagcaattttcaaacctgtaaacatttgcttttgtagtcaaaattgaaagatacaattgaaaggaaagatttagttcacaaactgtataatcttctgattctgcagaattgaaatgaataaacttgaacacatatttaagaactcaagctctagtcagcatataacttaagagggaaaaggttgaatttcctttcaaaataagcaccgtgcatgaccatgcttcctaagaaaaaaagaaaaggtaatatctctaaaaattgtatcatcattattttcataccagttaccatggttcaattagtccctctctatccagtctagtggtacatttttctaaattgtgaaaattcaataataattacatatatagtaatatgtatttatataatattatataatatgtaaaataataattatagtttatataaatgtgtgttttaagtggtcttattatgtatgatatttcaaggtgtaagcttatttttcaggatattgtgttttggtacctaggaggatcagctttgaatcatttctagttacatatttctaatttgggggaaaatcagtttttataggaataaaatgtggtccaagtctttagcagagtgaaggataagactgaattataaaaagagaggtttaataaagtattttttaagccttagaggaagttaataaaataattttattgaattccatcatgactcatcttctaatattaattttgtaaataggaaaaaggtaattaaattactaaagcaccttcattttaaaggttaactttattattattgctcataggaaagtttattttttaccacttttagaacactaggtctttttaaattgatgcacaattcatttgggtgctttctatgacacgcagtcagacttgcctccttcctgtgtgggctctgactatctaataaaagagataatgtaatgacttacatatctagaacacaaggtaatgattccattaccaggcatatccctgttctgatttgcagacagtttaatttttacatctgatctttaactagtgcttcagatgaagcagaactgggtatttgaaaggaatttaatttgttttgcccattttaatggtagttttttctgagtgtatttaaagagctttttataactaccatcttccaatttttaaaatggaaatatattttctattgcttatttttttttactgcaaagccttatttgtttattttagaaaaattagaaaatactgcaaagaaaaaagaaaaatgaaaaaataatatattcttagagaattctcattaacatgttggcagatactccagtttattctatataattcctatatacaataggggatcaaagtacttgttacactgaataccatactctgacattacatattttgtaaatgttgttatatgtttttgattgagcaaccagtaatcatgttagcctgaagacaaactttgcatagttcaaagagtgtttgccaactcttttttaaaaaggaggtttcacataaaaatccagatgtccaccttctcttgatagatggggattctgtgctgctggggctcagaatcctggttggccacagttgagagcagatggccacagttggccttagccagccagagcatgcactctgcattcagcgcattcctgccctggtctccttcacatcttgatgtgcctacctgactcccaaagccagctgtttgaagggtagtagtttgtctagggtagtgcttttcaatgaggctgtactggcccctaagggaagactggaaagtgttttctggatgccgcaatgcttggagagcactactggcatttagtggactgcagtcctgttatgtgagaggactggacccggaagttgtgtcctgcattttcaacaatccctttgggtagtcatataggtgaaacacctgtttataattatttgagcctggaaacaaaactggttgcacatataaaaattgctttaattcaattttagtatacgttgaatttcctaagactacagctactgtataatttcaggtaaaattgttctttgctttggaaggtttactgtgcattgttcaccatttggaaaaccatgttgctgacaacaaggtggctcatggtatttgaataaccaacacagtgcagctccatcagtgctcatttgtagcacccttgttcaatacaacaaaaagcaaaattaacactcctttaacattttttatgaataagaaataaatatcagatcttatgagagaatattaattcttctttgtgtgttctttacttttaccatctataatttgccttggcatgttatctagacttcagttactcttattttccttttatcacttgcctgtaagcctgctttattgtttcttattctaatactaaattttagcctaatgtccatgtaaccactcaaccctccagtctttcactttcttactcttcttgaaaaagtactggctgcttattacttctctttaattcatatttacttgttggtagtagggcaggcatcagatgacttcctcaatatgtaagttatgttcatgcctggagcactttatgattaaaaagaatattatgtatagaggttgtttgtataaactatgagctttgtgttaggttagtaaaagcggcattacaaaatacttgtttttaaaagtgaagctttgtgcttgagcagcttaatgctctaggtgaccatcgagaatatacattggtcctaaagaggcttacaggcttctagaaagacattacatagaaataagttatgcctagactgagaggatgatgaaatatgctccaggatttcagagaggggcaagtaggtgtgtttgaatggatgaggaaggcctgtggatgaagccgaggaggtgccaccaaacctagatgcttggggaagctgttaagagttttggagaaggggacaatgaagcaaagttctctccctttctttttcacttccccctcttctttttcttctagaactgtgtcttttcttctttctttcctgaagatgcaaaagccacagatgtaagtgagagggactaaagccagagtcatgactatgaagtattgatttcaggtgtttgttctcaccttaaactcagaccaaatataaaaatatgaccttgggggcttagaattgtgcagtttttgttcttcaagagaaactattggagagatctcagagcaaggcattgcttgtatttcccttcagtgtagtacttagattttcattttcttagatctaattataaaagagacttaggaggtggaaaataaattcaataagtcttcaaagtttttcctttctttattttataagctaagtatcactgcattgggggtatactaagaagggtatcaatgacagaattgctagtttcctcaacctgcctcagcttaccaaatttaactctttttgtgaaactattaccacatgtaaatatattttaaaaattagaatttctttgaagaaacattttcctagccaatcaaaagcaagagctagtgaggcttcaggatgatttggttttcagactttttttttctaatgccacaatccttagatatggtgggaaaggcacttcaaagtgagtactccagatttaattcaaatgcacccatttaagtagctcagaaaattgcatcatctagggttctggagtgacagtgttttatatgttgaaatcttttggagtgggattgaaacagcaaaatcattttatttcattaaaatcggtctcagcctcttctttttcctctcattcaccgcaggcctttccatctaagaaacaattcatagctgcttcttcagaggatgtctaattttccctcattcagagggacacatttggtactttgccctgtgttttaattagtaagcttcagagaaagaaagtcgtcagagccagggcccccagttgtggaagtttctatatccggtaaattggatccattccagggcagaatcatttatcaacaaatgaaacaccagccacttcccacacgtcctctgattgcattaaaaaatcactccccttcctacccaaattgagtatacttagagtatggagctgacaaacattctctttccttctcctcctcctcctcctcattctgttgaattgctggtttctgtagtctattaggcttcttattaatagtaataaaatgttcattcattaactctctcatgcctgcataccagctatagtaactgtctttgcccccaagttatgcagtctttataaagtcgttcagtagcagggcaatgagttgggaaaactgatattgcatctgtagcatcaggtactatttaaccagtgggagggactgataaaattagcaagttgactaaccacttcccttccttgtggctctttaatattataacggatacagaaaagttcagaaggactgagctagtttgcgaaaccacagcacactttggcaaagagggaatgcacaacaaaacgggtaagtttctttattttaatcttttaagagaactgtgaaaaagatagtggggtagatgtttttaagtctgactctgcaaatcgtctttaataacttgtaggctgtggaaagataaacttgtcatgcggagggaagcaaaaggttttccaatcagtaacagtagcaacaacaacaacaaaaattacattgagcaaaaaattcaactctgagaatgcctttattatttcagatagacaagactaaagtattttggggagagggttcttgaattaggaaaaatattgatgaataagttcctgtactctgattttttgaaatttagcccggaattgtcagcaggggcattatctactgaagctgaatgtccgcctagatcctgaaacagcttagtcttctgttgtcttctttgtggttgaaaatgtttgttgcttttaactccttgattatcaaaaatttcaaacacaagcaaaaatagagtgaatagtatagagatttcccatgcatctatcacatagcttcaacagctatgacttcagagcccaggttgtgtaatccacacctctgtggtacactccctccttcaatctagttgaattgcagcattttgaaatatgcctattgtgaacattaaataaaagaggcctaaagtttcctaaaggctcataccagctcagcaatataaagtttagagaaatattattacataaaattgaattatgagtcatagaaagcacaagtgagtttccactggttgttttaccagtgggagcaggagtagaggatagtagatattaagactgtagtctctggagccaaactgtttggggtcaaatttggttctgtcacaatccagtatccttaagaaaatttcttaacctttctgtgtctcagtttcctcacctaaaaatgaatacaatagcactgatctcctgagcatgagggatgatgaaccagtgcatgccaagactcagaaaattgctgggaacatagagtgctcactgtttgttagccctacaactgttggtcaaaattattagagtgatggtagggttgtgatttgtccaagcagaaagccaaaggttgtatctgagcatattgggctgtcttctgaccattgcttttctcctgattattttataatgccaggctaggaaaagtctccattgagatatcttgcttgcttttgcaccctgggaaaactccttgctcttgctttcccccaccagctctgaattaattctctctacaaacaaaagttatctgaggttgtcttgcccaccctctcactttgaggatgagggagtagagattggtctaagctcacagagcaaggagtagatctaatggaaaagaccctgtcatgggcttcatggactcctctaatgtctgtttggaggggcgctgcagttgggtttaggcaacactgttgggccttagaggctgcctcatatctgagctcttatgcatccatctctgatgtagaggtcttccagggctgcaagttgctcagatacttttttcattgctaatgagaatggtgaaattctgaggatggcaacaaatggatggtgaggaccttccctaagctattttttttctatactatagtaatggctgtcatttattgagcatttacaatgcacctggcactgtgctatgtggttttcttatttaatcctccctatatccctatataatacttaatattaatatcttcattttatagaaaaggaaactaaggtgcagagaagctaagctacttacccagctcataagggacagccaggattttgttccaagtctgtctgacttcttagagcgtttgtccacaagaaataggtttgttcaaacatgtgcactcgaaatgcatccgtggttttgctcttaggcttcctgaagatgaaagtcgtcagtattcctataaagcaagctgaatggaaaaccttttctctagtaatagttttcccacagtgtattttcagaatgcctaattacaagctggaaatttgtcataaattttgacaaatacagaggcgggtggggatggtgtggagttaccgctgtaaaaagtaaatattgaactgacaggtaaaaaaaaagaaatgctcttttagtaaattaaccatgcttcagtggtggattttgtttttaaggccatttgtctctcttgagtttttgtagaggagggtgaaatatatctaagtcagtttttgagaacatggagtgctgttgtaaaacaaatgataaacattgatgcgctgcagaaataaaaattggctgaatcttctgggaggtgctgaagagaactgggacatgcacagtcagacattttagaaacctggaattgacttgaagtgctttatcttttacattacgggtacaactgcaaaaatagaactgaatgtgtgaatgaagagagaggttaatttcacaactttggagttttttttcccctccaatagagtaatggtgttttaaatttttttttttcttcactcaaggggacatggtctaaaatttagagctaaaaatgcaaacatcagacataaatgattgacttgccttttatcaggcaatctgatacaatttgcaatcgttcatttttccttcgttggctacagtacttttgtcatcttgacagaatcagccaagctttacctataaaaatattggaagagatttgaaatcatatgatctttttgcagaaaaagaaaaggataaagggaattgcagctgccagtgttggggggagtgaagtgggaagggtcactgttatgtcacattcttagattcttttttttttttattatactttaagtttaagggtacatgtgcacaacgtgcaggtttgttatatatggaacccatcattctcagcaaactatcgcaaggacaaaaaaccaaacaccgcatattctcactgataggtgggaattgaacaatgagaacacatggacacaggaaggggaacatcacacaccgggcattcttagattcttaaacctttgagaaagcagagcagctctttagtactggccactgcaaaccatcttccagaattgttccatcatcttggtttttttctttttctttttgtctctaatgtcttcatctcataagaacatattcacaacctgtaaagcatggtttagggtcggaaatttctgtatttgtctgtcattagagacagattcagagtgccatttagcttgtcagtgtccacttctttgtgcagtaatgtaatttctggtggggttggtcacccacgggattactgcgtactagtgccttcatgtttacagattgttttctatcctgatctttaacatttgtcaatgcattatgtcactgctattattaaatgtaaacatttaataagttttaaaaatcaataaacattagtgcttgatttaaatgcttgatttaattattaacttaataatcaatttaaattttaataataaaatgtattaaaagtcttgaatagataaagcattgttttcccttgagatgaattctgtcttcatttgttcttttgtccatttattcacaattgcttagcatctcctgctggagatccagaaatcaataatcacagtttgtgccctcagaaaattcacaggtttggggtgaaaaagagttgtatgaaataagtgatgctatagttcacaaaatatattctaactacattgtactgtctacattgggagagagggtgtgtgtgtatggataatcccagaccctgggattagagaatcatggttcaaagcccattaccctctggttttgggtatttaactaatgttcttattccgtggtttcttcacctgtaaaatgatactgagctgctaggggtgttgtattaatttaacatgtgatacatgttaagtatttatatagcgtatcctatagtctttgggggatcaaggatagtttctcaaatgaagttaactttaaacaacctgaatggcatagatgcttctagtcacagggaactggatatgacaaaatggaaaatagttttgcctctttgagaaagagagtaaaggtcagcatggctgaaacatgtaaaaagtggggaagttgcttagaggtactggcagaatccagatcgtgctgggcctagtaggtcatgttatgcagctgcatgttgtgcaagtgcaatcagaagtgattgaaaggtttacacggggagttgcatgacctgaataatatttttaaactagttgcagagtggagaatagattcgtgaagagcaagagtagacacatggaaataggttagaaaactatttcaatagcttagtccaaaaatgatggccacttggattaaacagtgtcaggggtgtaggggcagtggacagagtgagaaatactgtataattaataggacttggtaaacaattggatgtcattggggagcatcaattatgatcctatggtgtttagcaactgggtctagtgagacgtcttgtgtgaagatgggcaaattggaaaaagcaggcttggacttctcaatttacatgcttttgaaacattcaagggaagatgtcaagtaggcataagatgtcatgtagatgttaactgaagccatggaaatagatgtgatcactcagagagatgggatgaagtgagaaaagctgagggcccagtacttaaccactggaaattccaaaatttagaagacagaggagaagcagccagtaaaggaggtggataagtcatggtcagagaaaagggaaaacaagaaagttgtagtttttaaggaaaacaaaagaaaatagcatattcaggagaaaggagtgattatccatgtcaaatgctaaggagctaataaataatcaaaaaataccatggaattggtatcatggagctcattgacataaagtaaacaggcagaaaatataatttctttaaaattgcattgcattttaacatactgactaatcagttttactgttgactaattgaataaatatatgaagacaataaaagagacatattattttcccaagtggcagtatatttagaaattatcttacttctatctttacataactgtatggtatacaaggaagcagtaataaactatgctggtctaaacttacttccttggaagtgcaaaagtacttgaaatcagcactttcttcttgtgtattcccaatatcaagattaccaggtaccattgctgagggaaccatttgcgtagaccagtagttctcaaccgggggcagtttggtaccccagagcacatttggcaatgtctagagatatttttgattattacagctggcagcaggtaatgtagggggcagcatctagggggaagaggccagggatgctgctgaatatcctataatgcaccagacaaccccccacaacaaagaattatttggccccaaatgtcaatggctgagaaaccttgacatagactaatgcagacctgctcagtgccttggcaatagtagatcttcactagaatttttctgcaggagagtgggagatcctttactgcctttttttcatggtctaccagtaggtttgtgtagtaagtgatctttgaatttggtttttatcttgaaacttctttgtaaaaaacaacgtgaataaataaaagtattgtgtactcacgtgaattacctctgcagaattttcaatagaatttatttatgtggttaaaaatagaggacagtgctccacccagtgcatgttagacttcttacagcagaactggcttccttatgcaaagttagttcctatgctgaagtgcattttagagaagtttcagtattaaaacatactttaaacatttaatagattaattttctttaaacctgtaaagatctacgtctttaaaaataataaattttattttctcttgattataacataattcatatagctcatatttgtgtgtgtgtgtgtgtgtgtaactataataaactcttagatacctataactaacgcaggatatggaatttaaccattatcaataaaacctcctttgtgaattcccctcttggccaaggagaaacacaattctaaatattttgtttcttgtttccttgtgttaaaattctactacatatgtatgtatccccaaacgaagtatgaaattagtttttaaaatgtctatgcctgtaggatggattggaaaggagagccatggaaaaaataaaacaaactcaatggctatttgagaaatgcagacacatggctttgaggcttggcaccaagcgcgggggcagtggcaccattagaaagaagtagacatttctgtgactgtctgcctctgtggagaaagggggagcctaaggtcaagatgacagtggtttaaacacagtgttagaatggaggttttatgaacagaatcacagaaggaggcaggggacaagaagcacacaggctgagacagactttgtatgcggtgccttctttcaggaagattgaagtgccatgtttattgtctagacttgtacttgccatggaagcaggacatctgagagcttgctctgtctgggcaattcaagatagagacttagagacgtcattgttgagcagtagagctggaggtgaagatttgagaaacttccgtgtaggtacgagttgaagccacatgaaaggaagaaacctggggacaaaaagcttagggaatgcccatagctaatggtggtatttaaaacacattataagcttttgctgtggcttttgcttatttttatttaaaaacttttttatttaaaaaacttttaattaaaaactgttttatgtccacgtataggcttcctcgggctgtctttacaatatatgttatggtaggggattattaggctggcacaaaagtaattgtggtttttgccattaaacggagtggaccaaagaattttgcaccaattctttggtccatgtgtctgcatttctcagatagctgttgagtttgttttatttttctgactgctctccttgccaatccatcctacaggcatagacatttaaaaactcaaatttcataccttgtttggggatacataaatacatagtggaattttaacaacatgttaaatgtttgaatgctacaataacattctaaactaggttagattcttgtgacagtaaataggatgttatggtttggcttggaattcttgtaagacttggcacagtttttagtcctgatccaaaggagtttagtcatcagaagaaccaccagtggcacagtaaatgtcagtgctaggtaaaaatgtgacatcaacaaagtttgtttctagggctgccattctcctttttgttagtttctttggtcctacatttcttcatcttcacaataagaagttggtctggataatgtgtcaaatcattgcaaaaatgttctatgctttttagccttaatgacgttccatcctgcctaaggcctgtgcctgggggatttcactctgccctttcttctctcacaggccatttaaatgttacagctctaaattcgtttttctcagagtcctgctacttactaatgctaatgtgtcaagtctgtattatttccagtaattcacaatacactatgattggcctaatatattcactcccagatggcttcttcactgggggtttcactgcctgaacctaaagtggtgctcaatggtagcatggcagaggtaagctaaacagggtgatattgttattatttattttcacaagtacttttctgatccatatttatctaacctttataaacataacattagaaatgtaagacctacatttttatgttttttttttttttttttattatactttaagttttagggtacatgtgcacattgtgcaggttagttacatatgtgtacatgtgccatgctggtgcgctacacccagtaactcgtcatctagcattaggtatatcttccaatgctatccctccccgctccccaccccaccacagtccccagagtgtgatattccccttcctgtgtccatgtgatctcattgttcaattcccacctatgagtgagaatatgcggtgtttggttttttgttcttatgatagtttactgagaatgatgatttccaatttcatccatgtccctacaaaggacatgaactcatcaattcttacttgagataattttcaaaagtttttactttccagtcaatgaactttctttgtttagcttgtatttgaattgactgttcttaagtcaatttttatgtgacagtgttgctacataggacactcttagtcatatagctatagctgtgagttggtttaaatatcccatataaaaagttataaaaacaaatagtaaagctgttattatgaatttacctataggaaaactgaaattttattaaaagtttcatatcagcattttgtgattttgtaacaacaccgtgaacgaaaacccagtaagtaggagggaaagtgttctgtatttatagttaggattgtatctgttagattcaaaatgatgagttagattttaaacttattttggagcccaactattcttgagtttccaaatgaataaagatatttatataataaaaattcagtttattgttgaaaaatgaattaagatgacagtaaataacctcaggtgtaggactctgcattgtaaagtggtacatttaatgtttatgcaagagtaagatttttttaaaaatttattttaaaaagtgattagcaccttggctgtacaactcttaagatttttttttttttttttgcaacactgcataaaatttgaagtattttttgcttcaaaatttgacctacttagaaaagttctgataattccaacgtaatatattccttgttttgtaagcgcctttgggtaatgtattggagagacaagtaatctcatcaagaagcgtaatggaccctatcacatttcaagatatattttttttcctagcacttctgcttcaaatttagtctgtgtttaatgataccacactttactggcgagggtacttttccagcagtttaactctctttgcatacaaatggtgttttgggtctggctgccattactgatcttttccttgaaatgaggtgacataatttgattttttacagtcaggaaaaaaaggtttagttcaccttgagaggttagagaaagaaaggttatcattgaatgaaatgcatggcttgatgccatttgtaaaacaggttggtgctggctcaagaaggcaggaacaaattctaacttggttgaaaagtatgattggcggaggggtaaaggaaaatctccagaattagtcattcaggggctctgcaatgtagatctgaagcagtgcggagaaaaggctaccaatccaccttcatcttagcaagcaagcactgttcctcttcttgattccagggagctacgtattttagtcaaagatgttaaattttgaaggcttctcaagagactgtcatgacaagcaagatattctttattatctccttttgttaatgaagcagttgaggtcctaagagacattaagtgactttcccaggaactcagataccaccaccctaaaattcaggtcttcctccccttacagcagcctctctctagatcaagcttgtccaacctgtggcctgcgggccatgtgcagcccagggtggctttgaatgcagcccaacacaaatttgtaaactttcctaaaacattatgagatttttttgcaaattttttttttttttttagctcatcggctatcattagtgttagtgcattttatgtgtggcccaagacagttcttccagtccgtggcccagagaagccaaaagattggacgctcctgctctagatatactgacttttccaaggaatgacaggggttaagatccgtttttaattggttccactcctggtggaaggctttcttctatacatgtcaggttttctttgacttatcaataccttcatgaagaaacaatgaagtgaaggacattttaaaagcaggttgtataagccactaaaaaattttgaataatgcctagtctctgcatataagtaaaaaaaaaaagcagtttaacaatatgttaattatatgtagacattatttttatcacaataaaattaagacatactacaagaacagattgacttagtttttcagtttgcaattatcttcccagttaaatataagtaaagatcttaataaatgtaacattaaagttcttgaactatataccacacaccattccacataaacagaccggttatattaaaactagcaaagccgtattttgtctgtgcttgctagaaaataaattttgcatatattctagaagacaaagatgattttgtatatgtaattgacaaaaaatacttctaggaaaaatataattattgtattaaaggttatgaaatggcagttgaaacccctaaagtcatggattctagttaatacagtataataagggagagctcacactattcctcatgaatcatgctgagaaaactcctgtcaaataaagaattattaagttgagttaaagaaattaatttgtttcttcaaaactgaagttaagaaatgcaaacatttttttctctggatgaaaacactgtttttttttcccgcaatgcaattttataaataaaaggtttattgcaaatgtattttgatgaccttattatactcattttgtgtgaaattatttaaaaaataatattccctcaagttaaattgctcaattgaaacttctcgcttctcaatataagcatcagaataatactttaaggtcataatatcagaagctattgactaagtgatttaaagatagaatgtctgtattctcagatggagcaaattaatttaaatatggtagttgaagttgcattttatgatagagcaggacattgttgtcgtgttttttaaccttaacctgaaaataattagaggaaaaagcaatctagatacattatagatttttttttattgcataaagtgatttaatcctctgttttattccagagacttatttaggtttcatttactgtcccactgggatagtagatagcataatactttctttcttattactatctaagtatttaaatgcagaaatggagatgaaaactttgactcctactgcatttgaatgtatgaatttacatatataaaaatgtacaataagcatgtgtatagaaaaaatcagttatattttttgtagctcttgctacagagaccaagagatcaaaataaatctgccctcaaatgagaagtgccagcttcttcgcttcccatttctcccaccagacactcatgtttaataatgagaatgaatgaatgatgcagtggataaaggtctgtcttgttaattagatgttctcagataatgaagtcttaatacacctgtgttttctatattccctctaaatcaccatagaattcaagaaaatggatcttgtataaatcttcagatctatttatttttgtgcatatgcatttgaccaagtaatttatttaaatgatttaaatgttcaatgactctactgcttttgaagtcatatgtgtggttcttaaaaatttaaaatactcaggtgttaagaacagcagccttaccatcagttggtgatttccttaagtgaaaattgaagagtttaagggtgcaagtcatacagcaattaagtagaaaatgtacatgtgattaataataattccagtctacttgtttgtttgcactcttgggtcagtgctagtaatcttacacacttaattgacacttgtgacatatgcccatatgcttagttctctaattgtggttctgaaggggacttacttggcatatgtagtttatatgcatcatctcagtcagaaaatgggaaggaatccagatgatgatacgaagtatgcaatgttatcctttggtgaagacattgttattgtgtatggtgtggctggatatgagggttgaggtgtcaaagaagggcgttagtcttggagccaggaagatctggatttttacataagcatattattagctacctcagtgatatttgcaaactaactttacctttccaagtctcagtttcttcatccataatgccttctttgtgaggtggtagtaaactaaaaggaaaaaatttatgtaaagtttgaacctactttctagaagacgtgaacaaattgactttgccttcatttgtttcagtttcttcatctaaatgtctagtctgtaaggcagtaggaattgtatgatgaagtcattctgtaaagctagaaacaaaccttctagaaggcatagacagtgtctagtctatagtacagtgtttggggcctagggagtgctcagtagtcatttgagtgactttaggcacttaggatactgacagatattaaacaaatattatttctgtgatcttctttttccagagttctttaactggttgaattactagttaacaatagttaatcatctcagttaagtaactttttccttcaggtcttattttgtacatatataatatataatataaagtgttgtttgtcaattgtttttttttatgacttttcctaaaaacatgattttactggatgcagtagcataaagaagccattaaaatattgatagtttttcatagaaagggtagaacaccagttaatataaagattaagtgtatagtaaattcaccccacctgtattatggtcaagtcactagcataaagctattaagttttcagagatggcaaatgggtagttatggaataagactcttttttttttgagacggagtcttgctctgtcgcccaggcaggagtttagtggcgcgatctcggctcactgcaagctccgcctcccgggttcctgcctcagccttccgagtggctgggactacaggcacccaccgccacgcccagccaatttgtgtgtgtgtgtgtgtgtgtgtgtgtgtgtgtgtgtgtgtgtgtgtgtttttagtagagatggggtttcaccgtgttagccaggatggtctcgatatcctgaccttgtgatctgcccacctcgggctcccaaagtgctgggattaaaggcttgaaccaccgcgcccggccggaatgagactcttacatttacgttgaaaagcataggtgctggagtccatggtaagattattagctgactaccaaatttcattccttctttttccatggaaacagtgcctaagcacgtggctggccagctaggcactatgacttccagttcccatttgagataggtgtggccatgtggctgagttcttatgaatagaatgtgagtgatttggcaatttgtgtcacttctggatctgtgctttaagatgttagttaggctccatgttccttccccgttctgctggctggaacctcacatggttttggtccagtgtcaaccttctgctgtagcagtgttctagaaatgtcagggcagcaaggtggaaagaaccttggttgctgaggtcctgccaacctgaagtgttacacaagaaagaaacttctctgttgtttacaacactgtattaattggtttctttgttacagcagcttagtataaaccctgcttgatagagagtcccatagaatttcgttgacctgggctctgcccagcattagcaaagtgttttgaatctccaagccccaggttcctcctgtgttacatggtactattgtgagattatactatataagagtttaaaagttcagcatttaaatataccagggactgtactaagtgccttctatacactgtcatttaatgttcatgactaagttatgaactagaaattatctggattttatggatgggagctttgaggaatgatgagtgtaaattactttcccaaaggtttagagctggtactgatagagccaggtttttaaaaagctcagactaccagacttcagagctcatactctcaagcaataccagtagctcttagcaaagtctttggaaaatattaagcattccataagtgctaatagtattattaattcttagcaagcatcatggagcccctgttataggtaaagtaatgtgggttgtgttttggggaccctcaggctatttagcaggggacacagatgtatagaaaagtcatcagagtacatgtactgcatgaaagttgaaaaaaagtaggttctctttgacaaaaaagtaatagagatcagtgaatctcagaaactagatcacctaccatgcaatcacaaaatatgccatattctacactgttgatattaaattaatatttaaggtccatacatcactttttaatgggggcagagtgcgtaagccatttttacgtattccaagacttaagaatatgtcttgtgatttctctaagagaaattctccagcagatcagaaggatagaaccctcagtggaaaatgtatgaaaatgatccatgctgccctggacgttcacatatgcccccacccccacctctgctgtccccaactagtgaatccttcctaacacatccagatgccatggtccctgattttattggaatagggtaaaaagtttaagaactggaaattctaaattgtgtttctttataggataagaaatcagttttttgctcacacactcttccttcagggcaggaagaccttctctgacccaccaatctgggtagcacctttccctcctggttattctcttttccagaattctgtatatttcctccatagcccactttttataattgtaatgtttgtgtttgtttttactggcacactgtgtatctttttccatcttcactcttgatgataagtgccacaatagcaaaaatcgtataccctccaccaaccagtgcatgtagatatcctaggccggtgcctgacacatagcaggttctcaataaacagtcatcaaatatgaaaatacatgaataatattaggtttgagtaaaagaaaaagaaatattgttagtttccccactttctcgactaattctgaaaaaggaaaatgaaaacatgttctggaatagtttgcttccactgaagctagaaatccacattcacatttgctggtcctttcaccttcttccactgtaccaacccatatgtgtccaaagaaacataactcaaagctaaataaagcatgactccccttttatcatcaggttttctggtctgtaagtcaaccagagaagtagtaatctagaactgtttgaatgacacatagttctgttgtacccttgtagagcacacaaagaaacaaagtttctgatctctgggcaggggtctaatagatgagaagacaagacatatgcatagcacaccatgtaatatagagtgagtaaagagtgcaggcagtaattgcttaagggtttaggaaaggaacttggtacagtggcctgggctgataaggtgaacttggaatgggttggtgaagggaagtacttcccaggttttgagggactaactggaacgaggaaggtaacctgagccaagatgagtgagctagaacaccaagatgtattttagtttgaatttattcccgccctcagcaattcactccccagtcctgagacatggaatgaagtgtaagttgtttatttgggaggagatcccaggaaactccaataggggaaatgaggcagggaatggaaggcagccaaaaaacaatatgttatcaagtaagttggtgtgctaggtaactaaagcttaattctgctggggaactctggaaatctctgtacaacaggcacacagggtgaggagctggggtatttcaataccaactcctgaacatcgttattagttgggggctgctgtgggtaggactcagactatgggtggggatgttaattcctcagcacttctggccactgaaaaatacatccaatcgttacagttagaagtcaatgtctggccagtgtgtactgcagtcgcaaaagcaaggagatatgggtggactgttgatagcatctgctatgatgtgttttcagaagtaaatctgagttttacccatgctccagaaatatgtttacatggttttgaagtagcagcctttgtaggaaagaaaagatgatagtaatctaagtttaattaagactgagtaatataggggtagtttggaattgaccaatagattctgaagccttctacacatacttttggtctctctccaagtggtgctattcgtgctgctggtaattacttttcttcaacgccttttgatccaggcattttcttgcttacgatctttggatggatattcatgctggcaggattaagtcttaactcctcagactttaagatttctacagttatttcaactgtttttcaagcttcatcaatattgctgaatataaattcttcactccaaccagacttatttactcacactcctttttgcttgtgctattttggatttgcgaaacaccccccacttacttaaattctttccattctccatgtctgtttccaaactccctcatgcagccatctcccctggtcatctgagccagcaggctgagatctcacttctctcgtggacctcattccacagttaacattgtgacatgtattctatctattaatgtgaagttaattttttcttatgttattaaatttattgtgtgtttatatcttggcccttcagctacaggagggcagttcttgtgtgtgtgtgtgtgtgtgtgtgtgtgtgtgtgtgtgtgtgtgtgtttgtataggaggaggcaagagtatcttttttaaagccatacctctcaagttcaaatcctggcttcctcatttatgagctttgagtccgtgggcaagtaattgacacctcaacaaccatgaacatttatacctgttaatccatgagtacaaagggagggcacataaatgaaagttctgacgtgtattagaaaggttctgaatatgagaatcatcttgaacacattgaattttgtgaaaataatggtaattgttcaagaccattataaaaaaattcatttcccccaaagttcttgttaccatgtcattttcacaaataaagtgcttgctctttcttagattctaaaactagtttctaacattataaaatcaaaattattgcctggtgccatggctcacgcttgcattcccagcactttgggagtgtgaggcgggcagatcacctgaggtcaggagttgtgggccaggctgaccaacatggtgaaaccctgcctctattaaaaatacaaaaattagccaggtatggtggtacatacatgtagccccagctactcgggaggctgagacaggagaatcccttgagcccaggaggcagaggttgcagtgagccaaaattgtgccgctgcactccagcctgggtgacagagtgagactctgtcccaaattttttttaaattgtaaaattgaaaaaaatcgtaattattattaaagtcatagtaatattttaaaaacaattatcacacattaacaaaacagccgatgtcactaacaccaaaggtcagggtgtggaatatatgcaccaatggttctccatctgactagatatactttccaggaaatgaaaatacttggaagcttttcaaaaagttctagaagaaaaaccatttctgatacctacaaatatacatgtatatgaaagtgttacaaatataaaaatacatgttttcaaactcaaatgtaattttaagaactttgccttaatttatattgccaagtagcttaaacattttaatagtgtcactgactgatgttgattgttaaagacttcatccaatttacgaagttggttttagcaatctatatgaactaggttaattaaaatgtgaaatttgcaaaaccaagcctacgtagaatacttttaaacatcagaagaaaataaatcactgttgtagccttgtttctttcatagttatataaatttgcttaaccatatacaagaaaagaacttttcttttgaggaaaaggtacactcgaactctgatctgtaattatttaagctttgggcacttcatagcctaatcatcatttgctgtaaatataccatactccctttcaaaatgatatttaatctgcatttagtacgtggtattggattttacatttcttaaagatatataaaagttttggtgtactcagtaggtgattgaagatgtgctacttcatggagaaaaatatattaggtgtgtctgacctggaaagaatgttctattaatctttttcttgtgtcagatttataacaaaaagaagtggaaactatattaagcaaggatataagttacatatatatatatgtgtgtacgtgtgtatatatatctgtaggatatgaaaagatgttagccattatattttctcttattcttgctgttctctaatttaaactcaaattctggggattcgtatgagtttttatgggtaaatactaagacaggaagatagggtttgttgaatgatcccttcttcagatccactttatgatgcaggctttacctgtgtgcatagatgtagaaacaggtccagaaacaccagggaacctgaacaaagtcacatggctggtgagaggagaattcgtgtcaactccaattcctttggagaatatatgcaaattatctgcttgtgtttgtggagatctctaagtcaatccatattacccacatttcaatgcataattgtgagtttactgagactttgaccagaagtattgtaaagctgagcttgttctatggcgtttgggaggagttgaaataaatcatttcaaggacaatgaaatgttcagcccaaggtacactcgtccttggtttaaacacccatttcctttaaggactttctaatgagaccttgtggattttccaaaaaatataccgtgccagtggcagcttattcaccttacttacatagttcgaggaactgcttgtttaaatttagatactgtctctgatgaaatgttttgacaaagtaataccagcttgatactatttaaaatattttgacagatgggaaaattgtttcagtctgagttgagcaatactttattgcagtattttgtgagttagaaaaaaaatggtaaaggtagcctcactgttccccaaaataacatccttccattctccctgaggagagaaaggcctctattcagtcatagattacagtatgtgtgctgagtatgttaagaattcacacagtttaaacaagagggaacatttggggactgtttccaaacagggaacatttattgttctataagcaaaccgaacctaaagaactttcgggaacatttgttgtggtagcatgttatcagagccttctcatgccgtgatgagattgttctcaattaataaaactaaatcactagattttaaaactgacttggatgaaaaaaaaagctcaaatttacctacttcaatatctagagttttaaaaaatatgctattataataaaaaatatttaaatatttcacattagttgcaaaggatgaaatccaggtggtccttgtttgtgatattaaacaaatgtgttgaagcaatgtggtagggcagtggtcctcaaagtgtgattcctggaccattagaaatgcaaattctaggctttctggttcagacactggtgcagcccagccatctagatttttaactcgtgttcctgatcattcagatgcacactttagcttgataagtgcccagatagtgtagagactttcaagctatcccaaggcctgccagattggaaagagggaggactgtggtgggggggtggggttggggggaatgatcaggaatggttcccaggcttccccatgtccatttcaactatgggaactttgattttctgttttacgtatcacagagttttatgttgggctctgtgactacacggttttgaaaaacactgggatagatatttctttggaggacgatataccatggcccagaaaatctttagagaataacagcatctctggctgtgttcacatcattttagcaatatgtgtgtcctgaaactgaatttggtcagtaaagtaagagttagcctgtgtgtcagtgacagcctcatgttaaccagtctcctaaggaacacatgtacaaatcagaaatgccagttgtatttttctaattacaatcagaggcataacaaaaaattatgcatacactcacgtttaacttctcctgatactcgcactgtgcacaagttaacatttagagttgggaatatcccaacaatcccttgtccagtgattgaattgtccatgataccaattcaggcctccacctttgatatatacctgcaggtgtgacatagacatcatacagcattgttaacttacagctatagaatcaggggaaagagaagttgacattttctacagatttttatcaacttgtacaaatccattacacacacacacacacacacacacacacacacacacacactctcttactaaattgctgagggccgctaaattcagtgtctttctgaaccatgttatacaaatctactctattatctctttcaaatttctatttctaaaaaaagttatatattattgatggttatttatatagatttttaatatcattaattaaattgtaataagatctttatgttaatgtaactttttgctcacatcaattttatattgatattatttgtttacctctcagttctggagagaggtgatgatgatgatgatgatgatgacaaaaataggttactgtttttataacaaggattctgcagttaacatttagaggtcttacacagtaccaaacagtgttctaagtattttatatttattaatactttttattcacacagcctacttatgacaaaagcctttaaccttttgaacataacccccaatgaaaaaattgagatttggtacatatatacttcctttatgtatatattgtatatgattaggaaaagaaataatgaatcaacttttattatatctaataacttgtgagtttttattcccttccattttattatgtttaatttcagttttaaaagtccagttgagattcagaaaattgatttcattactcacattaatagtcacagcctgcagaataaaaaattgtgctatcagatagataatattattatttatattttacagatgaggaaataggcacagagaggttaggttagttgcccaaatttacataatgagtggcaaatccgcagttcaaacttaggtagtctgtctccaaagccctcgctcatagtactatattctgtcttacctagtcagctccttcatattctactactgtcaaggagggatgaaccaaatggggaatgtttttctcccaaatatggggacaatatagtgacagcctcaaattttctaaatagaaggatttagagatgaaggaatggagactggctgtagactggcgttagagctacttttccatttgaaggcatccttttatttaggatgtgtgtttgttttaggaagtatttgtaaagaggctgatggagattactgtggggggaaatggcttttgccactgaaccaccctcttggcactaccacgggaaatttattttaaacaatctaaagaacagtaggtggaaaagatgtgtacccagattatgtggaccttcctggtgaatgaggagaggacaaagtgattgtagggcctattgtcctgactccttctagggcatacagttagaggtgcaggactgctaccatggctgcatatttttgaacacagacatattctttccctggtgcttttaaatgtgatttaaaaatatgtgtcagatgagcaggcacaaaatgcaaagataggagagccatacagtgaaaaatctatttctccatcttttccttggttgtctctcttttctctctctttcctagaaacaatcactgttgtctctttcttgtgtagccttccagaatgctatgctgtgtgtgtctgtgtgagtatctgtagtaaacattaaaatattactacacattttctgtgccttgaatttattcctcttattttatgtttcagattttgttccacatgtggaagtgccttgtgcctcctttttcactgctacatagtagttcattgtgtgggttttccaaaattaatttaacagatcctctgttagaagacattaggtaatttataatctcttgcaagcctgattattttaaatttaaattacacctagggttctgagtcctctatatggtcttttattcttagcagaagcttcacaactctctgggtcttcagcagggactgataaagatcaaattgttgaattaggtcaggtttgtgtcaggaagttgcttgatctcagttttcttagatggctatttttagcttgtgaacagtaatcatggtaagaaatctttgtatcttgccctagacaatcttctcttggaaaattaaagtggccccctttaaaagatttaagaaatgcaatttgctaacagtttaatgggtttattagggactttgagggtatatttctagaaggagaaatatttttgtttctctgaaagttctagctactttattctccatagcccttaaaaacttttcagatttgtcttcctataattcgtagagatttggaaaattagacataaggcacctgttttcttaaatgcatggttacctattcctttgtcctatcctttcaagacaattctgggaacagtttgttcagctttacgaagaaaacatttcttcatcacctgagttttcggtcacccatgaattctaagaatattttagctgatttcagggaaaaagtattcaatattagtgattgataattatatgaaaaatagaccagtaaagcaatcaagtggaaacttggtagaaatgtatagataagtgacctggtccattctgcatttttctgattcaattatatccacagtaactcagagataacaaaattggtgctatgtagcaaataatctgaagaaaataatgctataaattctttcagaagtgatttcagaatttaatattttcctgtcaggagatttatgacctgacactgagaattattaaggctcagatccaaatacttagttcattttctcttgctcagcatttagtaaagatgtggaacacactagtcagatactggttagtcaagctcggaattcaggatttcatatccttgtcaccatgtgtgaactttggaatatttggattttaatatatgcaaatgcttttataatgtgtgatgtgttaggtgaaaattattgcacacactaacaatttaatttaaaatgctactcttgaatattttataaaccactggaataataacatagccttaatgaatataaaactgtttcttcttcctttgttaaatcatgtgggctgcattctacttaatacactgcctcaatttatccttttgtgctaagattttaagttaaaatagaaaataaacaataaatcaagttggactgcaatcatgttcacttgggaaatttcacttagagacatttgatatatttttggagggatttcagggatctacattggttaagttgaatctgtaatttggttatacataaaattaaagttaatctaagtggacagaatcaatactcttgtgagtttaattagatggccagcttccaagcaagagattattctttttactatcctcctatcctctttccttaggcagcaaaataattcctttgccaaagtatgttggacagttccctggtgacaagttctatagaaactcatagctatgctgttagcaatgtgagacagaagggagggatatgtgggtgaggaggccattgtattctagagatagtaataagcctgccttatctccagatcatagcccagccaaagggatagtgtcccatttgcagaggatctgcagtcactgtttctaaaccaaacctataaaacaggatggtgtttctttcaggctgaaaaatcccaagacagaaaaacaggaaaagtcggggagataaattataaattagactggacttgcagtgtgagaatcctgctattaatagttacgtttgatatgagatgcctggaaatgtggcagtaaattggagtgaggttttatttcaggtaataactttccttttatctctgttggtgcattggcaagaaaatctagaagagttttaggaggactggatgctataaccttcattgttcttatatgttcagtgtcatacgcaggcttttacttattgaagagtaagttatttacagtgttttaagagtgagattttattctagctccgtgaaacaaaacaactgggttgagttgtcatggttgatattacagaaattatttgatgagtagatgcatttttagcaataaatttaaaataggtttagtaatatttaagctacatgattgtatttctaactttgtggctgtcttttaaataaatgaagtttgaaattcgtgttttatatttcagatttttattcttcatgttgcaccatcacaaataaatatgtgttaagtagttaatatgagcaaggaacagtgagaaataaagatcagtaagaaaggttctgtcttcaatggttcgcagcaacgtggttgaaaaaccttggcaagagtacatgaactaaataatattaaccacacacaggttgtgatctgattgtaggtattaggcagagtatcagaacagaatgcatttctgtaatcctcatgttaaagaaaatggattcttttctttttataagactaatgatgactaatataagactaataagaataaaccaacttttattgttctgtttcctataccttattgtaaaattaatatttattgagcacttagtaggggtcaggcattcactgttctgtgtttaccatatgtatgaattcctttagtccttaacatctcatgaggtgggcatgttatgatcgtccctttagaatatataaaggaactgaggcacagcgtggctcattagctgctcaaggtcacagagctcataacttatgaaaccaggctggtaaaacaagctgcaggacttgtgagtcaacactcttaacctctgtgctttatactttctctcatttcactgcatattagttaacacctctctgctgtaagcctaaatagatgtccaatttgcactaggaaaatacaggctttaggctaggatcagagacttgaaatttatttctgtagaaaaggatgagttattttgatgtaagtattcacagcactacataatttaagtgattaaattcatccccctttggtgaggttggggggagtttctaggagaatgacaccctcacctttggatgttgagagatgcatatttatggaagtgtgcatttcctctacctgctcagtctaaactgactttcttcctggacagatccttgtgatgatgacttctgtcacagatcacaagagagccagtcacaaactgggtgtctgcactgaagagagtcctttagagactgagtgtctgatggacctgtgtttgcaattgtctttttctatttatgtgacttcggaaagttactactgagttttatttcttcttctccttaaaatggtaatgataaaagtgaaaatacctagctcatagggtggttgtgagaatgaaatctgaaaacatctataagcaccctagctgcataagagctataccagtttttctcaaaatgttaagtacctgtgaagtcatctggagatctttttaaaatgcagacactgattcattttatttagttgatctagggtgaggcctgagattttgcatttctaacaagctctgaaatgatactgtgctggttcaagggccacactttgagtcacaaggtcctgcacaatatgcatagaagaaatgttcctattaataggagctgttaaagtttgtattaacagaatatttctgttgataactttgcactcagtttggggttgtctgctgaaatatgtacatataatgtataagtattgagaaatatggcatttagaatcttttcattgggaaataatgcattctataatggttttgtgctgcattgtgacaaaaaataaatttggagtcctctttggaataagattccattaaaaattcacccatgttgccaggtacggtggctcatacccataatctccgtacttgggaggccaaggcacatggattgcttgagcccaggagtctgagaccagcctgggcaacatggcgaaaccagatctctccaaaaaaaaaaaaaaaaaaattggctgggtgtcatggcgcacacccagctactcaggtggtgtattctcagctactcaggaagctgaagcaggaggatcgcttgagcccaggagttggaggttgtggcgagccaagattgtgccattgtattccagcctgggtgacagagcaagcctctgtctcaaaaataaaaaataagaaaataaatccagcactttgggaggccgaggcaggcagatcacgaggtcaggagatcgagaccatcctggctaacacagtgaaactctgtgtctactaaaaatacaaaaaaattagttgggaatggtggcgggcgcctgtagtcccagctaataggcaggctgaggcaggagaatggcgtgaacccgggaggcagagcttgcagtgagccgagatggcgccactgcattctagcctgggcgacagagtcagactctgtctcaaaataaataaataaataaataaataaataaataaataaataaataaataaataaatggcgccactgcactccagcctgggtgacagagtgagactctgtctcaaaataaataaataaattaattaaattaaaataaaaattcagccatattaaaagactcatgagtgtagtaatgaatgaaagatgtgattgagtaactttgtatcatatgtttatttctagcagccagattttcttgactaaagctataattagtcatggctctctgattattctaaaaagtgaatttattatcttgagggcgttgctcttaatatattttgaataataaaatgctgaaattaagtatgcttgacttgtgtctgataaatttgaatcttaaaacggacttttgaaaatataggaagaaaaactgtataggaatatcccgtcacttgtaatgttgacaaaaatagtagaacctatgactcacgtatgtatttcccaaacgtgagttgagtaactggctccagttgttactgatggcatgccgtgcttgtgccatatctgtgttctctgataactgctaaatcaactgctgcctaaagtagtgtcaaggcagtgaaaagcctctggccacctgtggaattgtttcgggggatgggactttctactttggggaaaatctgtaaatctatggtgtaaggcaatcctttgtgttttgtttctgttagactacttttgtgttaccaaagtagtctaacagaaatacttagtagtctaacagaaatccgtgttgccaaaagttcttcataaattttattgctctgtcttgcataaatggcctgtatacaggctctttaaaatggttggtaagagtggaaatgggaagagagtcttgccctacttaaactccagaaaatatgataatggttgcctgtaggagctctgactaatcatatattttttgatgacatgtgcttgccatcaaaacagcatcaaagagagaggaaaagaattatatcagagcctggttcatcccagtgtcctggcctcctagggaggtgttagaatgggatggttttttacttgcagctgcaagatacgccagcatctcttggatcagagcccttcgtgaagtaagggagaattacaataggactgtagctcaggccaagggattaatagaaagattaaattttgtatgttttaattcaatacaaaaatgctacataaacatctgcctttttaaaaaatatgaaatcctttccatcttggtgatcagcttgatcagcaaccacacctcacacttactgttttcaataacaaatggaatgcagatggcatttgtttcaacgataactacagacagcaataactaatgaataacttcagtgatacctggagtcacctgtggagatggtgaaaatatttagaactgacaattcctactgcattcatggaaaaagaagtaaagtggagtggggcctcagcatctggatttttaaactgttctattgttgatttgaatcaattcatcatgaattagcaagttgctagtaagtagcattaactactgatgatgatcaattcttttcttgagagacgaaggcagtaaactattacagagaaggtctgtgctttggcttcaaagagacctgggttcatactttgggtctgtcacagaattatgtgaaatacctcttttcctctgtttctttatgtgataaggggggataatactccctatatcatagggtggtggaggttaaatgtaaaaacataacgactagtatagtgcttagtacattacagacttttgctcctcaaagtctcgccctgggatcagcagtatttgtatcacagcagatagatccaagaaatgcagtatctcaggcccattccagacctcctcagtcagaatctgcatttccgggggattcctctgtaacctgtagtgtgacaagcactgatacaaacaaacgttaaatgtttgttagcgtagtagcatttaccgtaattgttgattgcttttacagttctgagctgataatcttaaaaacgccatgatggttgaaacaaaaacacttcgtggtatttattttctggtattttctttttattcatactaactagagtagtttctgttgctggtgaagatttgtttggggttcagtaaaactttcaaaatcgcctttcagatcttaagtatcttttagttatctccttctttttgtgtttatgcatttaaacataaactataaagccaaaatgcagtttaaaattaggcacaatgtatctacaaataaaagctcatctagcaaccaataaaatggaaacttgcagattcccagccagattttaaaaatcagatcaaatatttggaaactatgttatttgttgacgcctataaatttaaaaataagtcaaacaaatctgctattcttgcaaagcctaaattttatgagttccccatcattattggaatgagaaattgccattgtaaactctgtgctaaatttactttcttttttgacttttaaaactcaccaatatattgcttgtaatttagctctgacaaaaacataaaaaaggctaaatttaagaggcacttctgttgtgttcctcaaaaaaatttttagccatccaacttatgtatttgtcatctacagctaggcttaaatattattgaaattattgaaggcttttgaaagtttctttgcagttgtttaaaataacagctttgccattaatggcaggcaatcacaacattcatccagtattttgattttttttttcttggagcacaaactgagtgagaaaagtaattttctttttcacatatagaatctattttagttactctagcaggtttttgttgttgttgatgaccaattttcaggtccaaatgttaaccttaacaattcacaaggggtggtgggaactaaagattttttttcactctctagtccaacttacttcagcacctgctagtcactataggcagcctgacttttaacaggctcatcagcaaatccgtggatgaaatgtcttgaggacattcaaccacactgaggggcccagtgatcatcaaggatgcttgcagtagcagcctattaacttccttttatctgcttatgagattaatttgggttgatcagatacttgattgtactgtatttttctcccttcctgtactctgtggttgatttctcattaaatccagtggtgacacctccacaaggcttcgaaatctgtctttaacttccagctaatggaggagcttgctgtgaatagtacaagctcttatttttcaggacagtaataatgactgagggaataaaatcctttgtaccggctctcctgtccaaccttgaaagatgtgttgctgcaggatcggtggctcttcagagtatcccttattgtcaatcacgttaactaatcaccagcagaggactcttgaatttggcaaacttgggatttactctttaaaagtgctgttagctcatggaacttgaaggacctgtcattctttctgctgactcattttttattccttcattgtgctctggtatatgaggaggaagggatctctattttggtagatataattatgtcctttagtgaatttctgagtgagcagataagtctgacatttcctcccactttgtttctctccttggacaccccccaccccagttgtcacaatagtgttgtggaaagagcactgggccgggggtagaccctatttgcttggcccctgctctgcctgtggccagctgtgtgacctcaagcagtcccataaactttttaggagaactttccaattgtccactttccagcacatttatctaagtcatggtttagaggaagagagaagagagagataattaaggaaataactagtattgagaataaaaatatttgtcttaggttgaacatatgcaatcgccatttttgtaggctacgtattttcatagaacttgaccaaataggttcctctatccacacctcaaggcctaaggactctaacatatgtaaggcaagttctatagatgtgtcagaaatttccctactcaagtcagatctggcttgagtccacctagtggaggagatggaaattgttcttagtatttacaactactttttctatctcttcccttacatattattctctctcctccctggttaactccagaccttcagaaccttcatactctttccatcctatccattcatcattagttcatctaccttattcatctccctacttgtttcacatgtgtttttaatacttaccatattccatgtaccacacaagagaaaggaaaaaggtgagctagagaatggtcataaactcaataacaggccattctaaataggtgatatgcctttatgttgctgaagatactccattttaaccacagaatcattttatatgctttttaaaaaaatgtttgtgttattgtggaattacaggaataagaaaattacatgggaaagtggtttagttcagaaattgtacatattggtgaggtttggaaagactgttcctttatatactgtgcctttttgaagaaggttcaaattcctgtctgattttaggtagcacatgaataattgccttattagcttttcttctctttcctgaactaagccaagttccaatcaaattgtatagtgtgccccagatgagacgcgccctggtgcacaatagaaccatataaatgttgttatccacttcttttaaattggagagctgtaacttttttgtagctttgaatatttcatttagaatttatataaaaagtagggcagaaatcgaaatatttctgctttccattatgtattcgcctcatttttagagagatatttaacatttcaaactagttaaatttattttactcttctttgaggtgagaatgcctttgagatttctagtggaataaatgtaaagctcccatgtcactcggccttctcaggtcctttctctcttatttgaaccatctcctgacaataacatttagaacaatatcatctacatgtaaagcctgtattaaagtaatcccttcttcactatcgatttagcagcattaaacactgttcatctgtaaagctggggcacaatcagaaaattattttttctagtcccatactttaggatatgaatgtgagcatcacaatttgaattacttggcctgtttctttttcataatcacaaactttgggcataagagaaagatttttggatgttgagaaagggatattgagtgtaactgtcatggttctaagctatcacagagtaactaatttttgtggattaccatatcagatatcacagaatccattttacctccaagagtatagttagatacatctttgatttgtcagtgagaataactttcaaggcttacttaatgggaacgtatcattttgatataccgcgtcccttatcttctacttagcaagagattattatttccatattgaaaggatctaattctatagacagacgcagaatgttttttgtttgtttccacctctacagtatgctggtgaggatcatgctgattgccgattggcaggggcatccaaggtggttttcttgttaggtgcacaggagaagaaagcagacagtcatggataatagtaagccgacattcgagaacaggattgaaggcaaagtgtggggtcactgtaggagagagaaaaataacagttagtttcaagatgaagaaagaagcaagaataatgtccccttgggagaaaaatacctccaataagcatatgggaaatgagaaaggattcatgaggggaaaggaggattctgggaagggctgggaagttggcttggggaagaaaaggtgcctggtttagagaagggtgtcaggatggagaaagtatgacagggaaaagaactccattactaaagggtggatgccattttaaataatgtcaacctcaaggatggttggcccacttctggaatgaatagcatcaaaggtttatgtgttatttatcctttcttaaggcctcctcatgttagaaagtagcaaacctactcttctagatgctcaggcccataaccttggagttatctttgaacccgttcagtctcccagactccatatccactgatttccagttctttcttattggctctactagggaaaatatatctagacccacgactatttctcaccacctccattgctacctccctggtccaaagctctattctctctgtcagattattacagtagcctctgacttgttggcccagttcttggcttgggcctttgtttccatatagactattctcaacactttagtggagagtcacacctctcaaagggatacacacctcacccacagtgaaagctccagtcctcactatctctcatgaagcccaaagtcagggcttctcacctgggggcacattagaatcctcaggggatttttatagacatgctgatgtctaggctttaacaaatttgaatccctggaagtggagcctagaggcattgtatcttttaaaagctcccatgtcctaagttttggggatcaacaatgaataagacctagttccaagtcttaagcttttgacacctgaccagggacacccaccctggtaactgtaatagtctttggtgagtaccaagaagaacaaattgctggggaatctcaggaaaagtcaggtgtcttagtctgtttgggctgctgtaacaaaaacaccatagaccacttgactttaacaacatacagttattctcacagttgtggagcttgggaagtcaaagatcaaggtgctgacagattcagagcctaggaaggacctgcttcctggcttatggttgttttgttttttttttttttcactttgtcctcatatgactgaaggggtgagggagttctatgggatcttttttataagagcactaacctcattcataagtctcagctctcattacccaatcagcttccaaaagccccacgtccaaatacaatcacactggggatgaagcttcaacatatgaatgctgggggcacatagacattcaatctatatctccaaaactacacaaagtggaggggagtcaaagaagtggcatttttctggactttgaaggatgaggaaggctttccctgagagaggagagaaagtgcagtcaagatgacctcatttattatggctacaaaatgctagtaggaaccatgctgatgtgattatagaagaagctttcaaattaggcaaaccccggttcaatttcttggcaaattacttcacctcttagtgtctcaattttcctgtctctgaaatggagataatcatagtaccagtctcatagggatgtaagaattatcaactgtctttggcatattgtaggtacttcataatgttaactttctacaatagctaattaggcatttctctcaaagaaaagtaaaggaaatagcttttaaatggcttacggtttttcttgggtgctgtatacccttgctactcacaatgtggtcctcacaccagcacgggcagcagttggcagaaattgcaatgcctcactcagggcccattgcggaactactgaacagaatctgcattctaataagatttatcccccagatgatttgtgtgcacattaaatttgagaagcattattgtagagcataaaaaggtgagcaagaaatagctcttgcctttgtggtgcttagaggtccctttaataactttagcatttacagaaataattataatgcagggtataatgtgataaatgacatgagacgtcctcaccaaatactaaaatacagcagattgttttaagctccagttgaaaatagtataaagttccttttctctctaataaggtatgaaagttcttaaagttataataagcccccttccctttctgccatccttcaattgctgtaaaccatagagcttattgaatatctaagcagagagctacatctgtttatgcacattgggaacaattgaccaacaagtacgagttgaatccgttgcctgaaataaaaggcacaagaagtactagaagttaataaaaaaagacccaatagttttgtctatgagatgaagtagactatctagagaaagatcaaggttaagataagcatgtgaatataaatattagtttccttaatttttgatgctcagcgcttttcaaaagaaaaccctattttttaaatataacagcaatgaataaaacaaaaagaagtcttcaatttccccagttgacattatgatcaaaatatcaatttaataattatcctccttttaataggactgatttcatcttgtcaagtttaccattacaagttactagaacagccagagtaaagcaatttgagttccatatagtcaccacaatgtaattattatttttgaaattaattttgccgttttctttttgtttaagaaatgaggtcttactgtgttgcccaggctggtatcaaactccagtgatcaagtggtcctcctacctcagcctcccaaacaggtgggattacagacacacaaaattttcaagtttggggatatttaacttcagttcgtggtaaaaatcacatggtctagtgtaatctaagcaaaaaaaaataataaaataagtgtttctgtcactggctgtaaataatggtacagtcatgtgatagaccatatatatgattataatatcatgtttttaaagtaccttttctatgtttaaatacataaatacttatacctgtgtaacagttgcctccagtattcagaacagtaacatgctctacaggtctgtagcctaggaacaataggctataccagatagccaagttataccatctaggtttgtgtaagtgcactctgtgatgtccacatgaagatattgcctgacaatccatttcttagaatgtatctctgttgttaagccacacatcactgtatttaaccaaagtgaacacattctgctgggttttgttcttgatacacgtgtgtaaaattatcacttttcaggtgatacattagaccaatgatattctgacacagcagaaatgaaattattcatagcaaattacatttaatattttctgtttttaataaatgtaaagatctgttattgtcttatttcaagtttcatttttgctggcaaaaggttttggcctttactttcaagaacttaacttaaagtgaaattccctacattcttcaaataaggtatgcttgaataaaagcatctaaaagaaagtgtttttttataaatgacaacatacttaggaatttttacaatttgtttggggcaaaaattgtttgaaagaagtagatgttggataacacatattcagaaatatttatattattttcttggttattttatgctattggagtagatgcttcacttctctataggaattaccaattctcaattcctcttcaccacttatatatttttgattttgtcccaaatagccaaacatgctgccataacttctgagctcagaatgaaggatctgattaggaaaagcaacatgttaacagtgtacatgctccatctataactgtgatgaatgtatactttggatttatcatcacttttaaattattgagatttttaaaaactctattagtgctagctaagacttgtttactgcatgggctatgttgttttggtgcacatctatctttgtaagctatttctttctagaagctatttctttctaccttttgtacagggtagaaactttgcagaaatccgaggtcttcagagttagaattcaggggagaactgatgatgggtagtctattgatgggttaagtcctgaaggttattcaggtaaacatgaacctttcccctgaataccttattttctgtcatttcatcattatgattttggatgcctcattacatctgtaaaagcaattaagagttgaaggaattctttttttatagttcctgtctgctgatgacccattaatgtccatatagatatattataaaatatttataaatgaatacttacattgatttttatttgagctggttttacatttgacttattatttattggactatttaatttagtaaggaaacacctctttttcatttttaattagtgcatggaaggcttataagattaaaaatagttgtgtttagggaaataagcttatttcttatgatgagcagttacctactatagattatatttaatctggtaactaaaatattattattttttagtttacatatcagaacctagatataatggccagaagatgtaatgctataatatagttaatttgcagtaataatcacattttcagtaaatatttgttagaactatatgaaattgctgataattgatcatttctgacctacagatatgacagctgcatagattcaacctactatgaaaagccaaaacatggaatattacactaattaaacggttacacaacagaacatggaatgtgcgacacttcatcttgggatgcaaatttttgtgctaaaaaaaactgagaaaaacaaaaagaaaaacatgtatttctgaggaacttgtttttatatctggcataaatgagaaaaagctaattaaaactattaattatcagaaaattgaagataaagttgaagagcctataccaaccaaagttgaataaatggcaaaatataatatagatgagttactctgaaataattttttatttcctactatctaacttaccaaacttcctgattttaattacataacaattttttggttattttaatattcatttggtacttatttccttttttattgttatagtattagatgaaatcataacatcaatttgctcctttgtaaaagaggatgttgagttagaagtgttctaaggtggctttcagcaataggctgccataccaattggaaaaatctagcatggtataaaagaatatttaagcagtaattatgactggaaaacatcagagtggaaatgaagtatggctgagaaacctttttgcttttagctttttttggagttcattacaataaaatgaaattatagaaacttaacccatgagtatttttctctttgaactttagttcctattgaaattggagaggaaactacacagtaatctaagggtgatcacaggagatgtcagctgccttccagggctttttgcaacgtggaattgcctttactcgtttattgaagagtgcccgttatgtgttggggctggactcacagtttctagggtgtagatcttagccatggagatccagacacttacggggttaggatattgggagtagtgctcttatgcagggacaggcttgcattaaccaaactcaccagatattagtgtataaccaaaatgcaaatttattggtttacaataagaattctttgcactaagtaatttagaatacacacgtaaacccactctgtgctaactaactgaaagtcactttatagggaaaatcaaattataattagaagatcatgtaatttttatcctcattttgtgaatatggtgttcacatttactgattgcagatattgaaccatcctttcatgtttgggataaatcccacttgatcatggtgaggtgtccttttaatgtgcttttgaattcagtttgctagtattttgttgaggactttttgcatctatgttcatcaggaatattggcctgtagtttatttatttattattcttgtagtgtccttgtccggctctggtatcatggtaatgatggccttgtaaaattagtttggaagtatttcctcctcttcaattttttaatatagtttgagaaggattggtattaggtcttctttaaatgtttggtagaatttgtcagtgaagtcattaggtcctggacttttctttgataggaaatattttattactgaatcagtctccttactcattattgatctgttcagattttctttttcttcctggttcagtcttggtaggttccatgtttgtagttcatttgtttcttctaggttatcctacttgttggtatataatagtttataatagtctcttctgatcctttgtatttttgtggtatcagttgtaacatctcctttttcatttctgattttgtttgggtcttctttttttctttgttagtgtagctaaagttttgttcatttttatcaaagggtacaaaattttagagtggaggaatcagttttaatgtatgtattttatatttcaaaattattggagaatagatttttaacgttctcaccacaaaatatggtaagttggtgagttgataggtatgttaattaacttgatgcatctttctacaatgtataacataaatcaaaataacatattgtactccataaatatacaattattatttgtcagttaaaataaatatgtaaaaattatacttagaaggccactttggtaagtgtcggcttaagagtgaatggaataattgtcgattagtaaacaaaagaaatgtcatctctccaaaaaaaaaaaaaacagtgaatggaatgaactgtataattcaatgtttgatgatactggtctctgatattctgtgctctctgattcacaaaagtgatgtgcctgtcaggggatcagattgctcaagaacatgggccagagtataattcctgttgatggcacttggatccagattatgtcttttgaagccttctgtttctttcctccatttcacattacactctccttgctgccttttatgcattttatgtaggcttactaacccagctctctagcttagtgcctggcccccagaagtactgaagaaatgtttaactaccgtttagctagccacaacattcttactagttttgctttgggaatagtgtatattttacttctaaggtactttgggtctattttattgctgcattctaaggcttgtgtgtatgtgtgtgtgtgtgtgtgtgtgttccgtgtgtgagaataatgggaaggtatgatacccacctctcataccttgatgctttgggaaaataaaaattttctgattatattattttgcagatgttctagttatacttatcaatcttttctgcttgccaaatgaagatttagattgtgaagattcttttcagagacataggttcaaaactaaatgaaacccagggcatctgtaattcttcacactttagtgaagctctgtgataatagtgagtagatgtgtggtgtggggacacttggggtggtatttcagacacttagatatttgccggaaatctgaaacttgttagttcacatttagttttcactaaatggattatatttttctcctaaaactgctattccactattaaaattaatggacatacaagataccttgtctgtaaatagaacagatatttttaatattttgtcacagtcccccaaagcattagtctgtaatgttgactaatgggttgaaaagatattaacttcagaaaaaccaaagagaattaatctcttagaatacttctgaaaccaccaacttctgtttttgattttatatttctatacctcaggagggaaaaaaaaaacaaccaaaaactatttcccctctactccctccctgttttctaaaaataagtcacttttggtttgttaccttataacacatgccaaaatttatcccagagtgaatttttgtagccaacttagaaccccaaaatagaaactgctgacagttccttaaatacagtaacactggcaggtgccttggtaataaattcacaagcttagaatctacaaaacaataaagttatgcaaattggagcatgtaggaagaataatctgaaacaaatggcagaacagtaagtttagcattgtggcatcctggttttactaacacaaggcaaataaccctgaggagaatcagggaaattttagatcaaggaggattacacagacatacagtaatacatgaatacaatttgagttgaccaattaataactggtttctctgttatcacaaccataaacagagatgggaaactgatcataggttttgcatttgataggtacaactatcaagaggtaaatggaaaataacaagacacctaacttgaagtgatcacatgtgcagagcctcttagcttttgttttaattgttccttcagcatcattcccatcagtcatattcagattagttgtttaattttagccaatcaggcatgtaatacatttgtgaatttcatttattttaaatgtctttgcctttgcctaattatcttttacttttgttattaatctctgatatggcataatgaaaaatcgtgttttttaatgaaaagaaaagatgtgttcagttaacatattttcaggaaatacatattttcagttaaaattagaatagctctaataatatcagacaaaaatgtagctgaggaatatagcactaccttttattagttgtgtagtaaaatgtaactttttgaccctgtagtatcgcttgcagaatgtaacagaaatgtttaacttttcttgtttttgttttcatcaacctcaagttactcccaaagaagttcaaaatgtatcccagaacttaaagtataataaaaaaattttaaaaaaagaagtacaaaatgtctattgtgtacacaggaaaaatatattagaataatgattatcttaagtatactacctaccttattcgaggtgatgaagtagtggactgctacaagtttgttggagagagggactagaactgtccttttaaatgctatattctatatcatagcatttttgtctggcacttggtagatcctcaatagagattgcttgaaataataaacaatatcacctccaaactcaggttcacaaaatttgagttcagtggcacagtggtgatcacatgtgcggagcctcttaggaaaaggaggcctagagaagtattgagttagatgctcaggttccagagccaggactggaacacagatactggacttctgtcaagcacaatatacttttcatggcctttgcccgtcattcagatgtttaaatttgcttaaaacagtgccatctattttctttggagttcgaataaaagttctttctaacagagtgagtaattcacacacagatacttaataatttccctgattattttttcatttagagattttcaaactaacaaccaaaatattctggtagaaataaggtaaggttgagaagtaaatattataaactggtctgtttagccagagttcccctaagagccttcctcattccacctcaaagaccattttttagtttttccaagtgtctgtgaattgtggctgtgcatgcgcacatgtgtgtgtgtgtgtgtgtgtgtgtgtgtgtgagagagagagagagagagatttttactttaaaaaattctcatcacttaagcttgactgttgcttttcttcttgcatgtagcttttctaaccaaataaattaaaaatacttaaaattgagtatattccgtaattggtccaataaaagaggggatgcattggaagggagctatggcacagggattaaaaaaaatgttttgcacctggctcctctatattaggtgtggaatggcagtcaagccgttgagctgctgtggatttcaattaatgcatttctaaaatactttccagaaattcaagatggtgattatttaaatagttgaaaaatactacatctcaatttggcctatctttttgtgttgaagatagaggatgtaatcttttttcatgttcagtagactgtgagctaatagttttgttaggggctgagaaatcaacatacaccttacggcactggagaagcagaaacctggcttaatttcagaagtgcaggaatctttgacagaaatattctactgtgaggaaataaatttacacaaggatcccttctcagagtatttactaaagtctgaaaagccttaatttattttatgccaaaatttatgtttatgtcatgccaaatatagttgctgatattgttaggtattaatttgtgtgccaaaagatactctttatactgtattctctgatcacaatgtaataaagcagaaattagtaagaaaaaacagtaatacaaaataaacaacgatttggaaggaacaagccattaaaaactactgagtcagaggcagtttttaaacagagctcaactagagatagaaatagagaatgttaaaacagtctttaccattggatggggtgaagttggagagaggaaatggggagatttaggccaaagaatacaaaatagcacatgtgttggattactaattaagagatctcatgtacaacatgaggattaaagttaataaaattgtacagtattagggatttttgttaagtagattttagctgctcttgtcacacacaaatagtaactatgtgagatgatagctatgttcatctgcttcactatatagccattttactatctctctatatcccatgtcatcaggatataaacctcaaatacacaccatgaaatgtgtttttaaaacacttgcaatcataggttatttagaaaatagtaacaccattaagggaataaacaaaatggtgcaccttatgaggtgcagccaaagctgttctcatggcaaatatattagtattaaataatttcactatgaaacaacaaacaacaacaaaaaaccccagcaaatcatttaggtattttttaaggtaaaatttaaacataatctagcaatgttaaggagaatgaggtatgataaaatataaagttaaagaatcagtaaaaagtggagtttatatatgcaagagctggttcttaaaaataataatgacaaatgtctgaaaatatagctaaaaatgttaagtacagttattttaaaaatgagtaaagaagtttaaatgaaatataaattataataaaaatagaaattataagctaacacactgtgaaacttggtggcaggaaaaaagtcaatgactacttataatttcagagtagaaaaatacagattttgaaaagggaaaaactggagaaatatcatttgaggattacttctcaaaatgtttttaccagttagattttcaaattttcaagagataaattcttatttaatgaatagaagttgctagaaagtattccaatgactgtttttgaaggtctcatactcctgaatctaaaacctgacagaatatcatatcacaaaaaatctacagaccaataatttttatgactttataggcaaaagtgtaagtataaagtagcaaattaaatttagcaatattttaaaataataattcacctgaatcaggaatggcttagagtcaggaattcattaataatcacagaactagatcaaaagaaaaaacatctcaccagagatggataaaaagctattcctgcaggaaaatattaataaactagaaataatataatccttattatgtaagaaaatgtatctcaatctatttcataatttgtcaaatgccagaggcattcttgttacaatcagggcatgttttatattaaagattattggtgatggtcactttttcaaaaatcacgtaacttttccagtgcattaataaaaaacatacgtttatatccattatttccagaaactccactcaaatagtaataagaatttaaattatgaatgcacaggaaaaagaataggaacaaagataattgtaaagaaggaatgttagcaaattttaggaatatatgaagagggtggaggagttagcaccacagaggaagttcaggttcgatgtctataaggagagtgacattgagaagcaagctattttgctctctgaaactctaatgggtccagagattacaggcggggatgaggttaagggctgagtacataatggtaggttaaaaatgtgtgtaaataacaaatcaccagatcacttctctcccctctttggctcactaccctgcacacttaggagacaacttttctttttgtccggcagggttttagaagttgattattagaagaaattaatccatagattttgagactttcagacacctgaaatatgggaagctgggagtgagggattgaaaagggattaagagaaagtcttcatattgaaagtgagaattgtcaacttacttcccacctgcccaccatctttcagaagattttccaaccctaaggagataaataaaaccttgaaaataggaagaagtgaaaaaatggaaattggaagaaatacatgtaatgcagggcacaggagaaaaattaaaacaatttagcaatagctgcagagagataaaaatactgatctttatgccaccaacaatcttaggtcctaatcttgtggcttcttcagcaggtaggacggtgacccagagatcccatctcatggttcctttttgattgctcattgccatgttccaaggtttcatcaggcccacaatggtcttgatgtacatggattttcttcttatcttagtgcaagtctgggaaggctattagctgtttttcattgctttaacttgcaagagtctattggagcctgggagagtaaaagggcaagaattagataactttaattttagacatctctaacgagtctgaaaagattaatggggaaagtagatttattctcaggtaaagggtgggggtaaatgctgagctactgtttatccttctaagaatgtttagaatctctttctcatagaaggaagtaaagaaaaaggcaggattattagccctgctatacctggggtggtaccaaaccatcaccttcactggctgtcagcagaactgatgagtgaagaaaggatcatggctgatgcaatggtggggaagtgattttgtatggaaggccaatccataaataatggcaagtgtaagacatgaactagtatatttcaagaagtacttcagtcacacagacattttgtagtttgtctttttatttattttattgctcatgatgtaacattgatgatgtaaatgatataattataaaatatttagtttagagcaatgcttttacattttctcttaagaaaattaagaatttaccttctctagtcagaatggctgagatcaaatttttactcaaatgcttgctagatatcaggtcttggacaagtattttaacctcttgtgcctcagtttttccatttacaagatagaaattaatagcacatagcatatcttgtatcaggtcaaacagatgttattgttaatgttgttgttattattataagcattttggcctagcctcattttaaatccttcatgagatgttgcccagatctggttatccatgtgctatatcctaacctctctctttgtgtcccatgttttcacattcaaccactgacccaaatgcagtccacatacataagcagagttaagcaaacaaggctctgtggaatgaattctgtaatgagaagactgttgatttatactgtcctctctgctgtaaataacatcttcattttaacatatgtacttttcactatgaatatatgtaaaattgtctctatattttaaagaataaaactgatagaaatttggctgcaatcctagccatttgggtgagatttaattattattgctagtttaatctcatgctacatatttcaaaaagtcactctccaagttcaggatatttattataatacttcattatgctaatttcatgttttataagatgacaagctattgtcatgatttattccttgtctatattcttttgaggaagccaattgaacgttaagttcttatggatgtatttctttaaaaagtggtagtgtcataccatgtactgtcattatttaaaactgtgacattctgacagtgtgtcagaaaaaaatggtggctgtgtgaaatttacatgcctaagtttgtaactaaaactaattttgtcaggatatattttataattaccaatttaaagaagcgtataattaaagtaaaatgagctctgcttgtgcctagaaacataatttttaatgcttttgttagattttcttcaattgaattataatatatttaatttatatcagaaacagtgatagagtaagattatttttcaaaaaattgcagtcatttggagaaattcatgaacaacttactatattaattattttcacattaatttagtgacttttaaaagaggaacagcaaatcaaccaactttcaaatgctcccccttcttatacttctgtattttatttatagcagaggaaaacctttcttcctttcttcctgtcagctgtgcagtagcagttctactgaaattggataaagaatctccaaaatatgctttagcactttgagttagcctctgttcaataatttgagtaagatgattatttttctagctaaatcaactacatggtttcatgatataggtctaaaaagcagcttatttttttaacattcctgtataacactttgaaaacatccctcagtaaggggaatttatttttacagagtaactttgtagacatgtaatgaatgttttttacatttggattctaatgttataataatgtgcatttttagttcctgatctcatcttccttgcaagggcacttgctgactccggccagcctgatcatctggtaacagcgtaagacttgcagcgtgtgtatgtgctgaacttcattaccattgagtagaaatatttagtcgccatattaaaaaggtttcattattgaatgtatttgaagtggcccgcttaggaaatgattgggcatgtgccactacattcaaaaaagatggtgcatatttttaaaaccagctatctttctgaaaattgaaggagatgggtaaataacatctatttttgtataaaaattaaataactgtgaatgatggataaatcgcttaacttctttggacttcagttttctcatctgtaaaataaatgtaacattatccttctctggtgagttcaaatagttttaaaaatgagataatgagataatcaatgtgaaaatgctttgaaaagtatagagcactgtgcaactttaaggcattactatttttcactattgttttgatatttaaatctacaacagggttaagtacctttttcctggtaaacaggaatggaaaaataaaattattgtctttaagataattcacatttcagaagtagaaatagaatgtgcacaggctatgaagatacagggtaagttatatataatcaattgaatatgcagtaacaactcaccatgttggcaatgttgcagtgggtggtaaagtaccattgctattcaaagaaatatctgaacagaggaagagaaatgacaacgatgttgcagtgataatgacaacaatacggatataatctctattgaggcacaggtttttgtctctttttccttaatgttttcttagatccaaggattaggctcaaggtacgtagcaggtacttaataaatatttggcagtattactgagtgaatatcacttactttgacataaacaaaaagtttacacctattttcatgtcatcaagaatgcatttagtatttcctacttctactgaaaagtcatgtagtttttgttatttattctattaatatggcatcttttatttattgattttcagatgataaatcaatcttgcattattgggataaatcctacttggtcaaggtatataatgctttttatatagtgttgtattctatttaaataacattggtctataattttcttttcttgtaatgtgtccctcagattttggtatcagggtaattctgatcccatataataaattgagaaagagtccttagtctttaatttttatggaagtttacagagaattggcattattattatttttttaaatcctcggtagaattcaacagtcaactccatctgggcctagagcttttcctgtggaaggattttaaattatgaaaccaaatcctttaataaatatcgtgctattcatgctacctatttcttcttgaatttggtagtttgtgttttccaaggaatttgtccatttcatgtaagttttcaaatgtataggcataaagttgttggtaatattctcttattatgctttgagtatatgtagaatctgtagtgacgtcattatttccattcctaatattggtaattagtatcttgcctttttttttctccatgatcagtcaggctacaagtttgtcagtattctggatcttctaaaataatcagcttttgatttcattgattttctctattgtttttctactttctattttactgatttccactctgatcttcattattgcctttcttcaacttcctttgggtttcatgtgcttctctttttctagtttcgtaaagtggaagctgaagcaattggcttaagatctttcttcttttctactataggcacttaatgctataaattttcccctaagttctattttagcagcaatctgcagattttgatatgttttcattttcattgtttaaaatatttttaaaaaattaaaaaagaatgtactatgtgaagtaatagatacgataatttgcatagtagcttcattgtgtatatgtagttcaaaactttatattgtacaccttacagttatacactaaaacataaaaataacatatttcctattttttaattcttttatctgtagattatttagaaatgctgtatttattttccacatattttaagattttaacatatatgtttctgtaagtgatttctaatttattctactggggattaaaaacataacttctatgacattaattcttttaaatttcttgagatgtgttattgcacacaatgtggtctataagaccacatttataggtaaatattcaatatgcatttgaaaagaatgtgtattatgctgttgagttttctacaagtgctaatgaggtcaagtatgttgatagtggtatttaagtcttgcatattcttactgattttctgtctatgttttctatcagttattgagaaaatagtattgagatttcctactataattgtggatttgtctgtttttccttgccattctgttaatttttgcttcatgtgtttggaaccttttttattaggtgcataaacatttaggattgctatatcctcttgataaattggcccctttaccattatgaaatgatatttatctccaataatattctttgctttgcaaactatatgtcttaaactttcttttgattagtgttagcatagtatatcttttccactccattcacttttaacctatttgagtcatatttataatgagtaccttgaaggctgcatataattggatttttaatccaatctggtaatctccacctttaaattggaatgtttagaccatatacctttagtgtgattattgatatggttaggtttaaatctactattttgctactcatttcctacttgttctgtccgttctttgttccctttttacttttgtacctttttatgggttgattattttgaaaatgattccattgtatctccttttattggcttattgtctacaactcttagttttgttattttagttgttacttcaggatttatagtatacatctttaaattgtaatctatcttcaagtgatattatagcatttcatgtatatcacgggaattttaccaaaagtgtgtttccatttctccctcctattgtgctgtcattgtcatagattttactttatattagttataaatcccatgctgaatttttatgagttttgtttaaacattcaagtatctttagatatttaaataattaaaaatgtttattttttcatatggttaccttctcctgtgccttttattctttgtataaatcaattttcccatttggcatcagtttccttctgcttgaaggacttccttaaacatttgttgaagtccaagtctgctggtgatgaattctttcagtttttgtatgtttgaagaagtcttttccattttctgtaagatattttggctgggtatagaatcccaagttgacttttttttttcttttagtattttgaaaatgttggctccactatcttcttggttacaatgtttctgacataaaatatctgccatccttatcttttttcttttgtacttaaagtgtgtgttttcccccctgactacttttaagattttcccctacctccatgactcttttggagaaatttgatgataatgtgccttggagtagttttattcatgttttgtgtgtgtgtgtgtgtgtttgtgtgtgcacacacacatgtgcctggtggttgttgagctttttgattctgtggatttatattttccatcaaaatttgaaaatttttttgccagtatttcttcaaattatcttctactctttgggggcttcaaatatatgtaacttaaaatgctcccacatgttgacaattctctcttcttttttaaaaaatttaattctcttttttctgagtgtttcatattttggtagtttctgttgctgtatcttcaggtatgctaatctttttttcctgcgatatctaattggctgttagtctcatccaaagtgttttttatctgacaggttatagtttcatctctagaacttctattttgttctttctaatgtcttttatgccactacttagttttttggacataggggatacagtgacacaactgtttcaatgtgtttttttctattttctcttcaattaattctagggtttctatcagtttttggcctattttgattgattaatttttccttatttggggttatattttcctgctaatttgcatacctggtaattttttattatatgtgaaataatgcaaattttactttcttgggtcttgaaaaattttttgtacttctataaatattcttcagctttatctaaggacagttatttgaaaacagttttatccttttggttccagtcaggcatgactagagtaatgctgtctagggctattacttctcactactcggggaagcctcttcagtttactgtactcagtgtcccgtgatcaaagaggctttcctctcatttctagctttttgtgaccataaagaactattacctttaattctttaggcttattctttccctagcctcatttaatttccttacacacatgtacaggtcagtaccctgctgatttttcaagggaagaacttctgtataggcctggaattctctgtgttgtttggtgcttccctctcctctctgattcttcctcctgtgaacgctttggtgttgtcagactttcagctctgtttcttccactctgtgagtttcctcacttattcttcggtttctgctcactgccccatcactggaaaatctttcaaggcattaaactggaacaatatttggtctcaccttgaaaatttcacatctcacagggattactctcctttgttgcctcatgtccagtgtcttaaaatgtttgcttcaaatattttgtccatttttaattatttcaggtgggatagtaaatctggttcattatgccatcttgacaggaaatggagtttctgactcatagtaatttttatattacaagaaaaatgttttaaatgcttactttttcactttttattaagaaggctaattacctctctgcctcaattccctcatctaaaaattagaattatagttgtgcctactttcggagtggctgataaattttactgatgtaatggtataaatcactgaatagacacattgcaaacacccaataaattacttattttatcactattttatattacaaatcacatgaaacagtctttcatttgtaaatgctgtctgtccacttatattgaattcaatttctatttctattaaacaagctgaatatttgcgttatgtgcaagcaaagagtgaagtggatctactgaatgagagagaagaatcatacatcttgaaagacaggtggtaactgtgaatatagttagttgggtaaaatttcttgggagaaattgtattaaggacacttacatggtgctcaaaatgttcctctgagagtgaaattccctatccggagaaaagattcccagtaacaatttgccaagtcatttatttatgacttggatcctctcggtaccctcctgtataaaatctcctgtcaaggaagacacacatttatttccatctttctcagtaaaagttgggctgttaaaccagcagcatgggattttaacatatctctatggtatcttactcatcagttttttttaggcatgtgtcactaaaactacccactggaacacatttcaccgttccctaaggtgaaatgtagaagctacttaacagtaaatactttatgtcttatgaacttttggcaaggaaggtaattagtaacttggtatttaaaatgtccaaggaaatttatgttatataaattcttaacacagttataacatatttgacagagtttaatggaaacaatattaggcatatttcaaatcatcatagaattcagattatctacagaaaatgttgcctagtgtatggtgtgttcagctctgctgtgtctctacagaatattgagaaagggaagaaggagcgattttttaaactcaaaattaaaacagaaatttaagcatatttttatattaaagaatactttgcttaatgtacatttttaaaaacagcaaaatataaaacatagaaataaatttctaccttggatctaactagagagctcttttgccttctctacttttcttggattcagtaaaaataacaaccatttccgcatagattttatgggtactgaactgcattttctcaagaaaacattattttcttagtaaattcgcctttatatatgtatttacttctaacaaaaagaatcatagtattgttttatcaaaaagtaagcatagatgatatttattttaggatacccactaaagtaatacatagcctagtctagtctagtatagttcagaaatagtttagtaaacccttatttttccaataacccaactgtattgggtcaggaccaagtcatatctgccttctttacaatttcttctgtgttgagcaattcaatagaaatatcactttttagggtcttaatgagtaattgtcttgggggagtggcctttgacagaaaatattcagtttcttagcacatgtaatgtgaaaaattagggtatttcagattataagtaaaagctggaaatgtcttttcaaaaattatttttgttttgcaaatgctatgactagtgtcttgaacccagtagatgaaaatatctaataagatatcagaggtattatttgttgattatgtactatgtggtaggaactagatcaagcactttacggatattatttcaatgacttcttccaacaagcttataaggtattattatcctcatttcacagataaggaaactgaggttgaatggttaagaatattggccaagtagcacagaaagaattctaataatattgtctgatttcacatatagattatgttagtgactgtttcatagcacttatgtttacaaatggcttccagaaattgttcaggtagtattcgtacttaaatagtaaatcaaattaatctaccattctattggtcttaaaatcatttttctttgcatcccaaattaccattgtaaagttttcagggaagatagaatccacatattttcagcctttgttttggcagaaaaaaataggagttaaaaatttgcaatttgttcaaagtgcaaatatgctgtggcattttggcattattccaagggcacagatttaacttggaattttggtggctgttactgggaatgtactgtttatcaaattcagtgttaactgcacagttgaagattttctagcaaaactttctctttttaacactgaaaaaaattcaccaaattctaaggattgataagtaaaatccataaggagctgcagtctttaatgaacaaatcttctattaaaaagtaatcagtcaggtcattccacagagagcttgcataatcgggatttggatgatcttgggctctctactaaaagctcacggcctcacatcttaatggaaataagagaagatgaagtttatagcccttcacttatgtaatgagtgaaataaccagcaagcaaacacctgtcagatggtagtaggtgctcctgagaggtatgacaggtaataatttaatcagatgcattggtaattctatgacctgaaagggatattgtgtttccaaagcccagaattttctttcttctagataatgctgtgtccttgtgtacaaaatgacttaaaatgaaacattagaatgtagaatatattttagcctaaaatgttctttagttcttcattgctttcaggaatttctccctcctttgtgcttctaaattgttaatccatgcagatcatactaagcattatttcctttcatatattagaacaaatatctgattaagaggttattgacattaggaatcacaattctcctagccaaccacacagcgggattcaaagcttgttcatttaatgaattgttgtttagtgaaagtacatgattgtgttctcataagacactttgttccctttattattcaacagaagacaaaaaaaaaaaaaaaactacaaaatttcaaggacaattttttgcccttttagcttattatgctccctggaacatacatagaaagaggtgcatttgtttctcacaggtggatgagaattcattttatcttcttgagccaaggccctgaagaatctgattttcaccttttatttgactgggtgactgattctcttttctttacaagttggtgctgcctataccttcattcagcattttttttccccttttacctgtatttttgggattttactccccctgctggcctctggcatgcattagagttgactcttttccaacgactcctgtttctgtctgtttctcttcaaggagccgcatgtatagtacatttatgttccaaacacagcagaaacgacatgagtttaaaggtaggtattttaagttttcaggaactcatttttctcaattttttctagagagactaaagtagaccaatgctaatttagaaaatatagaaacaacattctgaatttttgaatgctaaatgtaattggtttaattacagatcattttgctaaagaaaagttatgttatggcccataatgaagaaagtttctttctccttcctaggatagcagtaattgtgctgcaaaaaacccaaaatgtttctattttaaaaatgtcttatgaattataaaacctttgaaattgatggcttgatgttgcagataaattgaactagatttcaaagtacagttaacttgacagtgctttgaaacaagggtcactcattgtcattacatctttatgactatttttatgagagaatttggataatttaactctcaaaaattgtcacatgctgttttagcttttgtagttttgcttttgttagatgtcacaaccgctattaacacaacttgcattttttcctttcatttatgttgaactaaaagatatatgtgaatattttctgggaattatttaccttagattgaagaggagagttgcagtttttacattgttcttttgctgtcattaaaagaaaaaaaatcatctgaccaggaaatagtatttttagtaaatatactctcagaatcttctccttcccatctgaaaataagatgtttttgctttttgataaggtaatggtcaatgggatcgaaagacacttttttcttccacaattacaatagacactggtatggtttattgatgattctcatcagttatatttcaccaaaatctcatagcaacaggagaaaatttcccattgtttggttgggagccagaagctgagagtgcaggtcatttttcttcatctgaggaaagtggaatagccaatccaccactttgttttctaggtctaaaatgatctgttcagtctttcctaattcatgggtgtggcattcataggagaggctggcggcacaaaggaaataagacatctatgcatcaatttctttatattgtaccatgggatgggggttttaaaagttgttcatatttgttttctgcaccatactgaatgaatatttcacagtaactctttttagaacacaatacttggtgaaaaataaaattcaccgtattaatgtaacattttccaatcctagttaccagcactgcaaagtacacaccactcaacaattgctagaatatgtagctatgtgtatttttaaagcatattataaattttcccactcttagcagaaagtgaaggaaaatgagcacttcattagcaacactcttagttgtgcagccaagaaataaaacatgaagtaaggtttctagatactatgggaaccccattatgactccctggggaggcttaggggaggatgtttttcataatgagtccatgcagaaagttttaatactagaacatccttacttagacatttgcttagatttctaccactaatgggaaaacaaaactaacaaaaacaacaactcccatgtaaattgtgtttattcctattcagttaaacaaagggatcttagaccaagttgataaactgcaacatgttcttatttattttattttatcttacgttattttattttattttttagacagagtctcagtctgttgcccaagctggaatgcaatctcggctcactgtaacctctgcctcccagatttaagtgattctcctgcttcaggctcccgagtagctggactacaaggtgtatgccaccacgcccggctaattttttgtatttttagtagagatggggttctcaaactcctgacctcagatgatccacccacctcggcctccccaagtgctgggataacaggcacgagccactgcacctggccggcagtatgtttttaatctgtatctcagtgccctctgtttttacaaagtagatgataagtattgagttttgaaatagataaagggttgacagtcatagattcttgcttttaattttaagagagaagtaggtagcaaattttggagttgaaagacggatcatgcagtaactagcaactgtttctcaaaattccctcatcattaggatctcttgaattgctggtttaaaatatcagtttctaggctgctccacaaaatattttgggtcctgcagttggacatgaaaagcacaagcaccccaggtaattcttatgatcaggagaatttgggaaacatttatctgatttaattaattatagaggcaatgtcagcgattaagaggtaagatatggagtatagattcgtatgttcatttaggaaatgcttagctatcaacacttattgagcatttatactatggaccagatttgagcacacttactacatgtgtgatttttgaacttgtcttttaccctttctgaatctcagtttctcatttaaaaaatgaggataataccttactcatggatttttgggaaggttcaattagatatgccccaagaaatgcttaatttttctgaaaaataccactgtttttaggcatctattatactgtaggggtcataatttaattatttctattaggtatttttactatacaccaagatttcattatgcaatcacacatctgttgttctgagctgtggttcttactggcatcttttggagatgtatttagaggtaaagaatcctttaacaacttttaggatccaaaatctcctaacacaaactttctccttctgccttctctttagcccttttaaaattggtgtatttcctacttaaactcacatatttcaacttcttgcaacactattaaaattacagctactatttgttaagcacttactgtaatccaggcacagtcctggatgctgcttgtattatttaatcttcacagtagtagtgcagtttaggtattatgactatttaaatggagtctgagaacacagaactcagtaattgagacagcatcttataggtatgatgctgtgaagaacagaaattattttaatacctgtatatctgtcttcaagcccaagttctgtccactataagctattcccataactttaatacagtcattttcccaatatgagaacatgaatttctcccattggcttcctaatggttttctgtcactcagagtaaaattcagcttctttacttactaaggcctacaaagcactgcaccgtatgtctttcatgttctaaggcttttgcatttgttggtccctgtgcttgaaactgtcttgccttaggtaagctgtgcacctctccctgacctcattagagatgtctttccagatgacctcccatacttgagaacatctacacacacacacacacacacacacacacacacacacacacacacacacacacacagatattgcccttcctccttgctggcttattttttctctatagcagtgatcaacagctaacatcttaacatctaatatagttttctttattttttctttctcccagtataatgttagtgcctgagaatggtagcttaatgttatctgctttatccccactgcctagcacatagcagggatgcaataaatatttgattctcaaacattgaattgggggacatatctgatattctttatgttagtaattttataattttcacagcattagaacttcatatgtgatatcttggtggttaccctaatattgtctttgttaagtatacttttctaaacaaagttcctgacaaaaaaaaaaatgtggtgttgtgttttacttttcacgccaacaggaatagcactatgcagaaaaaatatgtctttctatgtagaatatttagaataaaaggtttttggaaagatcccttactcaaataatgaagtggctattcaatattaatacttagtatatttcagttgttctttgctttggaaattagggctttggaacatatgtgagaattaggtattacttcagtattaggaggtcttctacttgctgacagaatacttcgtttgtgccagttctggccatcattcattattattaatagtagtatataagcatggtaatgctaattcaataggttttccaggttttttctccctcttgttattatcttttattttgaagtttgcctttatttcaagttgtatttgtgggtattcagaattattgtacctgtgtataactcagtggttcaaaagtcattagtctttaataaattagaatttattttaaaaattcaagatctgaaaacatcatttcattgactctcaagtaatgttaatgccaagttttgaaaagcaatttttctttttggaggcagtaattttgagtaattggattccatgaaaaaaatggattcaggagctaattgtgtaccaggtttactggcatttgtgcaaaacaacatttagcaactgtcagtgacaatactcatctaatttctctttatcaccagctggtcaatcacgtatcttcatcaatacaagtattttaatttcctctttcaggtatcctctttgtgtgttttcttccttctcactctcccttctctccttattttaagctactttagaaaatagtaatactttactgatgtgtaagatgcaaatcactttggaagtgagaaggtggatatttatacatttgttctatgacggggtttctaagtctgtcccactgggaatggttagtacattccatagctgtaagggaaaaatccacttttcccagaaataaaggtcaagagacatggaacaactcttttattatttgctttcaaaacagagggaatatgatttatgtcgaatataagcttatgtcatagctgtgcaggtgctgccgtgaagctgtgacccctgtctaatccccataacgacactgggcattgaccacatttgctttgtagttactgagctgctttcccaggggccttctagtttctgaacccagccgctgggtagctggtcgacccgtgcttggtgcaagaacattgttttgtaagtgcaacctgaaatacattttataacccctgcctaagttaaatgactgtaggtctgtgacggagcctctgtgattgaatcaaagtctcctcttaactcctttttttccttcatgaatttagtagtcggctgtaaatagttttttctgctttattttttattgcgttaaacataatcacaatgatttatttcaaaaacactaaacagttgcttgatatttacaagataaaatgtaatactgactttaatacatcattgcctgatttacttatataatttttatttatcgttgtaagatagttaacatttttccatgttgcttcaatatttttccccttaaagattaatgacttggtaaaatttgcagtaatcacacaaaaaatttgttttccaatttcattctgtcttccaacattttgatctcccagagttttaatattttttaagtttcctatgtgttatgaattgtaaaataaaacaaaaatcccccaaaacaaaaaaagacagctatattaaaagtatcaactttattttaaatcttattaatgctttttataatgggagggaagatatatatatttaaatgaccatgtaaagcaaagtgaggaagttaggaaccaggacgctgaagctaaactgaagttgaatctcagctctatcatgtcccagctctgtgattttgttaatctctcaaaatctgcctcatctgtaaaaaaaggtgaatgatagtaaaactatctgttgcatagctgttgtgattattaaatgagttagcatttgcaaagccctacataaatatttgctgtgtagataatgtttaattttgtcaagaacttttaaaagatgtgttttgagtcattcatacaggcacacacacaggttattacaattttatcaagaaattattagccttgtcttaaatctcaaaaaatttgaattgacggtgaatatgtggaaagtgacaatatacaaggttatccactattggaaggtgtgtgtggaacagaacagaactagatcacatagctgtggagaacaaaagctcaagaagaaaaaaattcaaaatgagtttatatttttctcacaataactgtgggcacccttcaagcttcagttaagtgatgacaacataattagacagtaaaatattctgtttctgaactgttctttgtgtgaccttcagttatctctgaggatcctcaggtttcttaaggtttccttaggctgtctgtttaatctgatttttctgaaaaatgtacatgaataaataggccctccaaccaaaaatattaatatttaacatttagccaaagaggtagcaaatattattttcaaacaaaatgaagtaagatagaagagctgagacaatataatattctgcttagagggaaacagtaggttgccactgatttttagtcctgtgttttgaaaactatttgagatagaaggactaaaattgcaatgaagattactgcaacacagttacttggtcctcctatcattaattgattaaaggtaattgccagggagtcacctctggagggcagtgcagtcttatatttgttgcaggagctccaggtacctttaaattttccagaagttcatttcaaagattcttggccttgtgagatgtgagtcattccccgttttaaatactcaaagggaacgtaaaggtgaaaacaaactctttttcgttatgatggttagcatgctagattcagggaaaatgacgggaaataggacttaccatatagagttagtgaatctcggtgtgcaaataaggagctggctgatgtttgtttttttccccccttttccccactttggttcagatacttgtgaacctccatttcatgatccttgtttttgtctctgtcttactctaaaatacaaatctgtatcttctaagaaaatcttttaacagcctcaccatatagggtgttgcagaaggtcagctcggcggccagcaaaatatcttccagtaccttaacaaatcagcaaaatattttgagaaatgctttacttttatgaacaaataccctgctagttattggatttgtcatagcatctaaggtttctctcataaccatactgaccttcatgtgctattgtattacaaaaccaactctttatgtaatcaaacctaaggaagaatgcttaattagctatacatgaccctgtgttatgatacaggcatacaaaagttattttcttcagcactatctagctattgtacaaagaaacttctttataaagtaagacatgggatatttgatgtctcaggagtaaagtaatattgggatttttttttttcctctgcaagctgtttgagagctttcagcagggggataccgtatttaaaggtagcctaagatctcataactccatgtgtcacaaaaactgtgtaggttatgaaagacttttctcgtgagcaaaacaactgtgctttttagctctaaatcatgacatagtcttgttataccacaaagaattaaagaatgttaagtaaatgactttcttccctccctctgtgcctctgaggatagttattaatgccgattcttgctgctgagtgatcctgaagctactgtggcaacctttttattccctgagtgcaaatgaatcctctatgaggtaattgaaggaaattgatgacattatttgctgtatcttgggtatcaacagcatataaatgaaaaacacagcagaatgcctggcctgtgttaccacattgacctacacatttggatctgaaagatctcgagctattttctgcctaagcagactttgcacctttgtgttttatagtgaagtagcaggtacacaactttttaaaatcatgaactcctagcattggattaccaccacctggtgtaagggataggttttatagaaacacaaagagcatggacttattcttttcatttttgttcttctttgccaattttaatgttatcttcacaatctgaacagtgtgacctgtttcaccttcttttattttgaatgttagtgtatgcacattctaagccaagggtggctttaccctttaagttaaattaaaccatttgggacttagcaaattctgggttgtatgttttaaggtgaaaaaaaagcactaaaaagaaaatttaaaagaaattttatcatcatatagggtgtggatgaatgattcaaatagaaaacctattttaaatcagccctactgaatgaactatactaaaaggacatttatttacctagttagggaaaaaagtcactttaaatatggtctctagttacttttcttcccatttattacatttgccacttcattgtgaccttactatgaccttgtagtttatgggctaaaggtaaccattatgcaataatgaaaatatgcaggccagtctttaccaccttgaaaaaattggtttcttatattttgtttaaattaacacactttgctatttataaagctctgctctacggtgcttgaaagaggagagaagaattaatcgcaactaatgtgcagatttaggcttttagagactgtgtttagtggaggtgagtcagcaggccttgttatattaattatagtggtttgattctctactggttttgattcacagagatatgcgctgtacgtaagaattaaagcatcaattgcttaggagaaaaaggaacttaaaaatcaaaccattaatacctatctttgctttcttcttttgtctaatttgttttattttagttatccaggcccagatttcctccactttccctttgccttgatcccaaaacctgacctctgtgaaaaaggcaattcatcaattggatgtggtgagggaaatgcccttcagaaggatctaaaacaggcaatacaaaaagctttagacagtcaacacatcggggcacgtaagctctgatgtgacttgttatctctgagaccagtgtttgcattcttcctggtttgttccttaggcttggaaatgcactgaaaccacagctggtcttgaagagccatagaggatgtgatacaaggaatgataaattaataattacagatcctcaatctgcttattgtcagtcattttttctaccaccagttacaaatccagtctttattctcaaacagaagtgatgataattatccttggtaaaataactttcacataatgttgattgcagacagtcaccaagggctatgctccaagtacacttctcaccatttttatacatgaaataaaaactcttattatctccacttgtccatgaggaaaccaatgtacagagaaattaagtacccttctcagggttacacagaaattcaagagctggatttttaccacaaaggatggtttagagcctctggtcttaaccttccaagagtctgggttcttgggaatcttcattttcaacataggctctttatactaccagaactagcatgttcttcagatattcaaaacggagacttttaataagttcattattaaagaagtgaataatttaggattaaaaaaattctgttaaaaatgggttgctcataattaatgaaggcagatatttaaaccatgaatcctttataaaaccttgggatgtgaaagcttattttgaaatggactgttggactgcatgctaaaagtatacccagagtgaattttcagagacattagagacaaatttaacatcaccctcaaatctgtggaaggttaaatatacagagtgtgagacattgagaattaggcatttacaggtacttttccccagagtttggtttggtgagggatttaacccccatttcgtgacactgatcaaggcaggacattttgaaggaaaagcactacaaaaaggaggaattgccttgtcatgttatgaagcatttaattctaaacttctctgttttaaaaacaaaagaggcctatctatagataaacaaagtagactcgtgatttccaagggctggggcaggaatgggtgggtattagccataaactggctagagggatcttactgcaagcgattgaaatgttccaaaattggattatagtgatcattgtacaatctggtttaaatgaactttgaaatcattgaattgtaccctttaaatgaccaaatttatggtatctaaatataccttagtaaagtcatttttaaaaatgcatgtaaaaaaactaaaaaagaaaaaaaggaagatccagaattgggtcttcagacagaatcattatttgcatcaaattcagaatttcccgtacatgatattaatttacttctctaatttgaagtatgacactaaatgtaacacgttaggtcatacatttggcaaagacaaattcttcctgcctgtactttttcctttcagtttttaataggtggcgccattattctttgtagcctctagagggcagcacataggtttttttttttttttttttttttttttaaagacaacaaacttgtaactcccaagcatcaagaatgcccagttgtttcagatgaactctccaattttagttcatcctgacgacctcacagtggaggaccttcctatagtgactcctgcgaatgaatcctcccttccttcctgttagttgctccctttcacctctggctatttaatgtccttgaaagatctttcagctctctctacaggggaacataggagtaatttcagttgaaactttcacaacctttttcctttagagagcttgatttttaggtaaagacaatagtcagttaatgaataaaaccggtatttgcacatgggggagggttgatgcccaggagattgtcataagaattcctgacacaagttcttcagatcgcatcggaagaatccggctatgccaaaagataaatgtagagttctcctcaatgtatgaataactagggatgcaggatttaaaatctataagaatttttaaagttgtaagacataagcatcctggtgtgttttttgattgttgttcttttcatttaattatttattattagtttatgtacagtagaagccaacaaataagggttggaaaggtaaattaactagcattaaggtatatactgaaagtcattttaagaaatgccttacctcttctcatccccacgattaatggcattttccctatgatcattgaattttaaaaatacctggaaatttataccattctaggatcttatagaatcttataggatttattggagttgattttagtgtaggagcctgaaacagttttaggtccccctcactatgtcttattgttacttcgtttctgacattcttcctatatatccaatctaatatatatgtgaaaaagggtagacatcaatcagtattaagaaacaatgagaaatgcctgaacagacctttaagctgtgatttaaaaaaatcgtatttgggtgatcctagcagttaaattgactttttctttccttctgtcgtctctgttctccttttttttcctcagtaaactttgattgcttgctaattgtgtgctaggccttgtttggttgtttattgagagaaagaaataaaggagaagggagagaacacaaacacaatttctgcccttgtggaattatagccagtataggagacagacaaaacagtatataaacaaaaaataacaatacataattacagattgaaatcaattctaagaaaaaaaaggtcagtaagtatatataacctttggggccaactttaggctagagagttaggaaagaatttctgaggaggtgaacttaggtggccctaccacataaaggattgggcaaagggttatccaggcagaggaacagagtatgagaaggccctgagtcaggaaggagcatggcttgttgcagaaactgaactagtgtctcagtgtttcactgtgaatcaagaagtaagctaggatgtggcttggggaggtaactggccaggactgaaagatctttgtgaggagcttggatttgtttctaggttgagtgatgcctccagagggcaaaagaaaaacagcaacattatctgattttgcttttgataggattattctggtttctctatggagattggattggagaggggctcatatgaatgtggcagaagtttagaaggtgtagctgggtgtggtggtgggcacctgtaatcccagctactcgggaggctgacgcaggagcatcacttgaaccccggaggcagaggttgcagtgagctgagatggtgccatgcattccagcctgggcaacagagagatactccatctcaaaaacaaagcaaaacaaaacaacaacaaagaagtttagaaggtggttgtgatctagacaaaaatgctcttgcaactgagtttcacctgcaatttaggaatgggaagtaatgtgttgagtccactgatgttgggagcacaaacacttatgtaggaggtagaagaaacagttttttttcctataaagttataaatagcttttagcttattaggtgtggctatgttgagacagtagttaatgattagtgggatatttaaaagtgattttggaaacatgaatatcttgtgatttttattttatgcaaactggcattgattttaaaagctgaggcaatttaagcaacttcgaatgagtgttttctctctgagggttggaatttggaaaaaattgaaatatgggagcagatgagaacatgaagaacttgataagtatacctacatatcctttgatatcattgttaggaacttatcttttaatcgaatgcatggtgccataggttattccttctctatatcacttagtacttaagaacacaaaactagacattagtagaatttacagatacacatttgattcctggctttaccacttactctagctataactttagacacctgtcccctcactgatatttctgaactggaaaattgaggtataataaccacgttagaagaatgtggtgaggattatgtgaaaaaatttatgcaaagtacctgtcacatagtcagtagtattcaattaataccagattaggtgatttgccatgatttgcccaaggacaacagctaataaatcgtaggactaatatttcaacccagaaggccttatgctaaaacctgcactgttcatcactgcccagtacttctttcttaaattggggcagtgaggccgggcacagtggctcacgcctgtaatcccagcactttgggaggctgagacaggcagattacatgatgtcaggagttcaatatcggcccagacaacatggcaaaaccccatctctactagaaatacaaaaggtagccgggcgtggtggtgcacacccagcaacttgggaggctgaggcaggagaatcacttgaacctgggaggcagaggttgcagtgagccaatatcgcaccattgcactccagcccgggcaacggagtgagactctgtctaaaataaaataaaataaattaaatagtaaattgtggcagtgaagggacaaggagggaaggatatttgctgttgtcccaaactatcttcttacttcttttcttccactaacctgcttttcctcaactctcattcacattttctaaaacttgagaatgaaaaattcaaaattgcataaaagtagagcaaatagtacaatgaacttgcatgtaactgtagtccccagcacctgctttgtgtctccagggacccagcaaggttgctttggtgattttttttgttgagatggaatctcattctgtcacccaggctggagtgcagtggcacactctcagctcactgtaacctctgcctcatgagttcaagcaattctcctgcctcagcctcccgagtagctgggaccacaggcacgcaccaccgtgcccagctaacttttgtatttttagtagagacagggtttcaccatgttgggcagggtagtcttgaactcctgacctcaggtgatccgcccacctcggcctcccaaagtgctgagaatacaggtgtgagccaccgtgcctggccacttcggtgattttctaaccacactgaagggcattttcttaaccctcattttcctctgcagttagggctcctgctgacaccaccttctgctctgccttagcattgccacaggacacggttacctcaccttccaccctccgattctcctctctaaacccctcacttcttgctcttctgctcttcttgttctagattgttttcagaaagtttttatggtttcttggactcaactataattgtaattaagagattaatctccagtcctaacctcttatcctatgtatattcctacattttcaattacttttaaacatttatggcaaaactcatatctgccaccaagtggatggacttcctttgtgccatcatttttctagtttacataagtgaaatgttcaagtttttcctctgtactgtcgtactccttcagtcatttagacccaatgtcctttggtaatatttttcagtatcttctccttattttattttcctttttctagaaacatgcatcaaccttatgacttgttatcctcattttaatcttttcccctacactttctgaacatctctttagccataaatttccagaggcctctccatttgctgtggaaaaaaaggagaatttaagaattaccgtttcaagtgcttttcctctcactgttactttaataaattcttttcatctttcaaggtccacttcaatctcatctcctttttgaagatttccatattctttcctcaaagagtaatatattcctttcatttagttactacagcactcttggcaccactcatttcaaaattattatgtagtacattgctgacaattttttttatttgtcttgttataccagtaaaaatgtttactttccaagagttgacatttttttatacttacttactttcagtgtctagagcatttgtttatacataatagttgaatgattgattttcatactagacaaataatgatcaatgggtaaattaattagcagtaagttatatacctgaaaattatttaaagaaatggcagaataattacccttgtctgggatcagttttgtaacatgccacagttaaggggcaaattttcagttcattaagcttcttccaaaagagcctagtttcagaatggaatggtgtttctcctcttctgagaattataagaaagtgctttagctagcaaattttttttttcctcccaggtggttctttgtctacataccatccaactatgaacaataatgtattttatagactatactaagatattgaaagttggagagatgtattcctttgtctgatcaaacctagcaaggagaaaaactgggttttcttctcctaaaatattaaattccaaaaattacaggtactcattaaaaatctcaaacaatacataagtaagtgaaagtaaatggtgatgaaagcctcttatccacccacacctctctcctgaagttacctagaccactgctttcagttcatttcaaacatctaatctattgcatgtcgatttatttgggtagtattcactgccttccctaccccttctttaccactgcacctcaagaagacctgaaaacctttaaattgaaatttaattatttcaatttaaacattcttattctgtatatttggtaaataattatattcacttatattacaccagggaaaccaaaggaaacattcatttctctttctttagaaacattttaactgactcaataggcataaaattttactgagggttagatttctgttgaatatatggttaattctacttctgtttaaggaaaagaccttaactttaattcatagagcaatgctgttgcaaatgtgtaattttccaaattgtccatagtccacaaaacactttaatgtattatttcgtttattgcaaggagagagagaaaaaaaaaaacattctggcataaagccaactaattactgatacactcaggagactcaccgtcagtacatgatatgctattttcctccaagtgttccttatttcttcccttctctccttgccagctccccgcccttctggaatttcttggttcaaggacaagtgctgactcagcatgggccaccttcttaggctaacttactgctttccctgctcctaaggagtcaccagagggggagcaaatggagcaccagcacattctccaattctcctaggtgtcgtagctctcctcactgattatgaattgtttctgggagaacagaatgagctgttaggctgcaaatgatctaacctttcatacttgaccatgtagactttccgcatttattccagtcctcatttccaaatttcactaacagaattgcagagatcgtaggattctattgtcacagaatagaaatctgtgatgcttatgtgttgcaaacctaatttctctatatatttgtgttagaggaaagttatatttttctattatctttgtagaagaactttggtttttaacaatcatggtaacttaaaaacaagtttcttggtaacttagatgatccagtcattaaaatcatgatatagattctaaatattggggaatttggagatttatgattcttaaaggcattataaaaaataaataggtatatggtatacagttctaaatagcttggaattatgagtgtaaatgttaagtgtactagcagtgatttctctttaaaaaataagcaaaaattgaccctggattgatgaaattttttttaacccttattcatgttgtaggaaattttatagacagacattgtaaaagagtgaatggattgctattgaaagataatctgatatcaacttaacttgctggtgactttaaatttcatatactggctttcatgctacatttatatcttagcaataagtattcatgagtctcatatttgaaggtagagaatcttgaatagtaaagagttctggtttacgtctttaaaggtcagaaatatgcactgttatatctagtttgtatatttcctctagtaaaaatctatgcctgactgaaagtgctgaatttatggtagaacaaaagagacttatcccacccagattgattcaaatacctggagataccagtttcagacatgtgttgatacagcttattaaaatagtaaactcactaataagcatttttgtattttggattgattaaagaatgtttatgtcaagaaaagcatattttgaaagtaattacaaccattagttataattaattcggtttatcttttttaaggaaggctaggatttaataaggtgggttttcctaaagcctttaatccatggcttttattttcaccacggtagattttccatataatttccctccttactttttcttaatgtcagatgaggtatatatatcttttgtaacttcctggtgtctgatcttagatacttctaaagctgattgtgaggattaatggacagggattctatccagtaattgtgggttttagaagaaacatactcatcctagagaaagaactggcacacatttgcccatttttgtagaatttggcctagattcgcaaagaaaaaaataaattttggagacttctgatggttcattttcttaagaaagaaagaaaatgttgttattattatttgcatttggtactgtgctatgtaaataaatcagtggcatctaagttagacttgattttgaagtgctgttattgattcactaagaaccactaagtttctccatctgcttcctatttacaaaatggagatgttttctgtttctaatttgcccctcagaagtgcagtgttataaggattaattagagaaagccaatgggctgaacagtgaggaagacataaatagagacaaacggggacattaccaggtgcctcctctttttgttcatggttgatcttcaatctcaatttttttatacaaagggcatctcattgtattatttggtccaatgacttgcattgaaaggatactgactgccccagaattcatttgcttttcttagtgaaatgccttaacattaatatttttcagggtctaacttttcctaaagattttcaggtcccagaatttcattctgaatggttgggctttatcagattatttttcaatagcaagccattcactcttttacaatgtctatctataaaatttcccacaatagttcataatcctcttttcagcagccttttctccttctttatcacttcttttgtccacttattttcaggatgcaaagttggcgtcactgacttgctcatggcttcttgaacatctgtgtgaggcaggattgctgaagatcccaggcttttgagttaaactgcctggggctgaatccctgttctaatctggctgtgcagtgttagtaatggtacctccatttaaccatctttaaagcgaaaaatttctcatggattcctgtgaggattaagataatataaggtctgcggcaccggcatatgataaatgctcaaaatagtactattacttgtattaacattagaaataaacatttaggcacaaggaaggaaaaaataagcaatcaggaggaagaaaaagagcagtcagaaaatggtgagaattagcatggggtgtgttttgaaagtaaagaagaagagacagtcattcgaaaatagagaattttctatacctttgctactcagaatggctcctggaccagcagcatgggcaccctggaagctttccagaaattcagaatctcaggcccccaaagccccaggaatctaaatctgcattttaacaaaatccccaggagattcattttaaagcttgagaaggcctggtctacaacctaacatgcagcagagttgacagatgagattaagactaaacaaaccttcgaattttcctgctagacctttagtggagaaaacagggaggaatgaataggtggcaaataaaagagagaaatcaggtattgataattctttcaggaagctcaaaaattaatcagggtgaaaaaacgttagataatacctttaaaatgtagcagaatcgaagggaaatttatttttatgaacaagaaaaagttgagtctgtgtgcaggtggagctgaagtgtcacacagggtaaaagattgaaaagtaatgaatacatgaagacatggatagctaagagatggggcaaagagtgtttgaaaaacattgacagctggtaagtttcagaaaaacaccttcatagactagtgcaaagatggaaagagtgaggtcaataagagagaagatatgtaattaggtgtcttcagggctgtttgctgggagtaagtagggcaggaatgttattggtagctgatgttttgatagggttagaaccactttggtgagtgagatagaactagagttgtaaataaattttagatctagtgtgaactctgataggtcggagctgcatggaatattgtgttgagaaggcttctgaggccaacataatattaacagataagagctatgtatgtcatgagcagttcctggcattataattagggagacatagtagtgtatgctctgcacattcaccatccctggtataaaggatctcctggccttgtatgaaattattgagtagaaataaagaactataacatgaaagtgtgatgaatcatttttgcagtattttgtcttctttctccaataatccttagcctaggaatagaaaatacagacaagggactaacgagcagtaataagcttatttttgaaaggcttgacttttatagtctttatgacttttttttttaataaaaaagcaaataaagcctacatttgaacaattttatgttttaaaaagtgtgggctcttgtatagaacagactatggaatttgaacatcacatctactactttttagctatgcctttgggcaaattatagttaagcattttctagaatgaaaaactcagttttctgagtttaatattagtagtaataataactaatagtaatttccaaatagagttgaagagaagattaaatgaatgtaacatcatgcctgatgaattcttctgctggttacttttatcctttagtgttgttttcagttgtttttttttttctgtcaatttcttctctattaaaaattgttttctgtcaccacgcaaagcaaccaggaatcatagattatggttgaaaaatcaaatggcaggctatttgaaaaatatttatttcaaaattttatttgaaaaaattccccactgctataatttaatgcttattcctaatctccttaatttccgttgctttatgtattatatagagataaggtggagggaaactgatcatgggtgatgataactgcagaactgctgtaagcaaggcttgttcagaaactgacaaatctattacaaagtgactcatggaagtggaggttctgtcacaaacagggtcagttattacttggcagtattctgtgtgctttagaagaaaataatgggctgacatagcatagaactttgggaataaaagtttctggatcatggcagttggcccaggacaccagacctagaatttgcaccggtagaatttgtctgccccaaagtaactggcaataatgccaatcaagacttgtgcctactcttccatgggttctggtccttcagtcacatttggccaggaaccttcttggctgatgaacttttatatggatacactataaaagagcacagctgagagccaaggagtgggatgcattaattccataaccacattttttctttatccttcaaaaaatttgagaatatatgacactgacagatgacatttttttggcagtgctgttaggtctttgctacaaggcagttctccatctttgtagttgcagagttataacttggtttctaaaagaaatcctcatagctattcacctggctcatatttcattctcagcttgaaattcaaatgtattgactctcctatttttatgtaaagtgatgcgtttagttagattgtcacatcttctatatattgtgtacttaatcagtttagtaagaaaaaaatctatagaaaatgctttggatgaagtatgcctattaaaatctcctacatttggctagttttattaacatgcaattcttaatatgtagcattcactacctttctatataactagtttctcattctcttcccatctgtatgagattttttcattttctttcagaatatacatcaaaataatgcttttgtttctttttcacaagtaatagatgttcatatcagaataatgaaaaggcacagataagtaaatagaagaaatacaatcatatttaattccatcattccaagaaagccattgttaattccagtgcattctaaggggttgcaaactcagatgcatagagaaggccagttgatatgataaatgtacaaatcaagctggatgggagccatgggactagtccttgcaagcatgtgggcctggggtcccctgttcttcctatttttcaggagaagaagggtatcagatttttatataacacatctgatattgaaatttgaacgtgataaaaattggtaaagactctgtagaaaccaaacagaataggtatgcacaccttttgctttgttccttttgtatatataaactataatgttagaaattacaatggtgtttgcatttcttcatttttaactgcactttaatatttcttccttgaataaatgacatttgcttatctcatttcctcttgataggcatttacattgttttaggctttgctattatggcaatcattttctgaacatgcttgtgcatgttttctggtacatgtatgggtataaggtatattggaagtggaattgctgagctaagtcatagggtgggtacatgttcaactgtgtaagataattccaagttattttggaagatgtttgaaaccaatgtatatgcccatcagcagcctatgaaggctgctagtgtttcccatgtttcccaacacttgtatgtttagattttttcatttttgtcgtttggagaatgttcgtgtgatcatttgcactttcctgattagcatgaggttgagtatcttttgaaacttattgatttgatacttattcaacatagtgtttcgacttatgggaaatgcttgctttgtctactttcttttgaattgtttctatcttttgttgacttatggaagtcattgtaataatttgatactaatcccgtgtcaattttattaccaatatcttttcccagattgcatatcatcctttcacttccttttagtgtcattgataaatggaagctttctttttgatggattcaaactttttttttaactaaacagttaatactttttaatgtcttgtttgaaatttcctatgaaaggtcataaagatatcctcccatattttattctaagatgaaagtgatctatcactttaccttttaatccatctgggatttttttgtgtttggtatgaggtgcagatccagtttcatttttgttttccatatggttagccaagtatccctgactaaccggtgatcggcagtgccactattgccatatatcaaatttcttatatatcaaacatgctgtttctgtttctgaactctgtttggttccattgctgagacctttgcttctcatgtacactatgtttatagagcaaaacatattgttttgctaaaccgtgctttattttctgggaaaaaaaacccccaaggtttatattaattttatgaaaaaatggctgtcagtttattttataccttttcccatctgcccctttatgctgattataaggattaaccctttccattatctaagctttatgatgatccacttgagtaatattggaaaagaaggaacaacatgtccaggtttcagacacatgctcagtgaggcaaaatggaatacagaaattcctacctaagtagtagccaagtcaaagagagaaatgcctctctgtggtgcccctgagaaggaacaggggttgtaactgatgaactcactatgtaggccacagcctgatgcttgaatatattgctgataaaaatccttataaatatctagatagtgattgtaaattaaacttgtattccatctgctattagtttaaaatctactaaacccatttttcagcctgtgaaaaatataccacctggccaagtgctttcacattatttatgtatggggcatttagggttttcttatatcttttttccttttgctctacttcaggatcttttatatgtttaaagtgaaaagtatttccacatatctctatttaaaataatttagtagatccttctatgtctatttttttgaattagaaatgcaattctggattgttgtaaatgaattatttgagtctgttttgtctcaatgtaacagcagaatagtggaattcgtatggaaataattgttttacacttaaaaaattcttttagtgacctcaaattcaagaaaaaagaaattaactgtatcattattttctatagtggtatttaaaatattgtaataacatgcttaccatgttctctgaaagtgaaccaagagagttatattgcagatctattctctgttttttctcctctgtttctttaccttttctttttcctttttttctttctcctcccttttttcttctcttttaaatatttgtaaattaatgtccttacctggaaatcctgggaatattttatcttgagcttgatatctgggctttatttaatgactcctttagtggaatttctaactataaatgaaatacattttccctaaatgctgtggactttgcagtacaggaggccgattaggtcaagatatctactattgtttttctatatgtcagaaacagtgtttcaaggttcagcaagtcatgaaaagtgtttcaaggtccatcaaggagagactcagagggatgattgaggaggtgtgcgctcactgtgtctgtccctgccatcatctccaaatgggattgtttgcatccgtgtaactgctgctctgaggggaaataaagtttatagagaatctttaaattattccagtgtaggaaaaaattgtaaggtcaactttctcatcacctgccaatgcaataatttttttttgtaggttgaaagcatattcaagaagagtttttttaaaaagatgtttaagacttacttttccagttctttttttgtaactacaaacagaacttgtcagtagaggtaatgatacagaaagggaaagaagtatgaattttaaatgaatggagcgcaggctattaagaaagtaaatttattcgtgcaaaccattgtgcatgtattctataggttattccagccccaactgggttaccttctccctgtactcactagcaatccagtcagtgtggttctagttagaatcccataaatctgtaacagaattaattgcatatccttccaagctagcagtgaaaggagtaacattggccaggattttgatgttttgccatattctaaaatcaacatgatggtatacgacattgctgaaaacattaatttagagggtggctggaaattgctgaaaatattgaactctagctagtgaacccaaacattctcctttttttctacttctagatcagagaagtccatgtagttaaaacttcactcttaatttaattctctacctcaagtatatatgcataaaaccatatttctttgtttagcaagctgaacactgctttttataatattagtctgtaaatcataagtgtgaggcaattggatcattgtgctctgtaaggagcatattccacaatagccagtttattttatttgacttttatctagcccttgctagcaatatactggattctgtttgatgcattttgcataagggttctatttggtccataatggtttgtgtaatgaactatttgttctcttctagatgacagccagttgcttaaaacctataatgagatgtcaggtgaattgcactgattggcattgatggatggacttgttgaaatattgcagagtttccgtaggggcgtagaggaaaatggctgtttagaggtttgggtctcctaagcactgaaactgtcatcacataaacagaaccacttctgcaggtctgaggtgtcatcgtgcattttctggctaatctatccattcatctcaatagtccagaactcgcgcatcatgtcactctttgcctttgttctgcactttgatctttcagaatgtctgtcagaagaaaagtgtttatattgaattatgtgtggaaaggggtaggctgcatacttcagaatcttggcatgaaatttgctaaacaaaccttgccagttgctccgcagcaataatcgaagtatggatttcaatttaacgatatgtaggtgcacacttttccccttcaaaaacaactttaatgtggatgtttgggtgtaggagattttattttgttttgtttttcctgtagaaagtatgtagcacctttattgttaactgttaaaattaatgttaagaaggaagataaatgaatttttcaaaatcaacttttttccactaaaattctggttaaatgcattaactaaatgtatgccttggctgaaatatctttttgtgtgtatattttatctcactgattctaacattctagtataagatagtctattttggtatccattatatctattataatacatgtattagaacacattaggaattccacagcaaaagcaaaagcaaacaaaaataggaactaattacattgaaaagtactatacagacacaatagcagaaacaatgggtgaattattagtttctgcattctgtcacagctatccattctcttttctcatacctttttaatatgtttgaaataaaaaataattatgagatcaaggtttttttccttcatagttgtctaaaatgattaaggacatcaatttccactgatatgatgctgtgggcaagaaaatgtataatggttcaattccccaggttaacttgccttgcagtgggcaaaaacagacttcagagatcttttgacattggtcatatgtctttcctcagtctggagatggaagttttggtgctcttaactgctatatcctgggcttctcgaggtaatgacagatcttatgctaacttagggaccctttggattaaaattgaatagtaacctgcaatgacatggatgatctttgaatcaataactttcttactacaaatgaagcattcatggaagctgaatgagctcagctaacccagtaaggtaactcacattcaacaaactgatttggtctttgacaaggctcaagtgtgagtagttctgaaagtttcccaggtgattccaatgtgcaagccaagttcaaagccactgagctaggcagattgaacagaatcattgcaactgtatgaatatgaagctttccaggcagaatgaaatacatggacactcatgagaatctagagctagctggtctaccaagggcttctcaaacctgcaaaccaagccctgctgatctaccaagagcttctcaaacctccaaaccaggacaggcatggcaggaagagggttgaaccacagcagagagctggtgagacaaggtagtctgttttccaggactgtattttcccttaagtgaagaccacgtcagatgttaaatgaagactatgaccctttaaaggctttggcttgcttagtatagacacttcttcccactcctagtgtcattcttgaatggtttaaaatatgttgatagaagagtaagaggggcagagctgttattattttctgcaaatttttaaacatgagaacatcacgacagtgtccctaggattataagctaggcccagacctagtctagtctgtgatctaccagggttgacagaaaaaagctttttgactagctgaacagcttctggcagacttggttgtgtttgatggcatttatggtgatgtcagtgatgccatggtagtgactggctgttacagattgtaaaaaggacaaggcatttggtacaggcaaacagaggtattaaccatataacagatttctctattcataacaatggttacttttaataaactggaaattgcatgtttagtcatttgtctgatacttgttcagacttggagtcaaaagacttgagttttttagcctcattttgtaattttaataattatttttactattcactatattctaactttttactagtatcaataaattaatatctcccccattatttttacaagtacttaggttaaatatctaattatagagtgcttttcatatttttaaaaatatcaactgtcaaccacaaaaagaactggagtcacaagtataagtctactgtaagtatactgctatgtatttgtagtaatttctagctgagcactaacgagtaagaaaaggtggtgtagtaagaaaaggtgggtgggtatgtttcttcatttatttcaagttatagtttatgtaaagttcatatggttttagaacatttttattgaggacctctggtatatgttaccttaaaaaaaaggatagcttaagtatccttcatttattcatctgtaaaacaggggataataatagtgactgcatatgggattattacaatacaaaaagatgtatatttggagggtcttagcaatgacagtgaaaactattttgttgagctttgtgtccaagtaattcagacatcctgatgaactttctttttgtttgaatattgaaaacatttttctactttaatgggatttcataataggttagagattccatgccaggaattgaggtgtaaatgccacatttgcaatgctacttcccttgaaatccaggtgaaactaaagaagctttgaaggaaacatgacaaaacttaaactcttcaggtaacccttcttttctaatcattgacattttttaggttgctttgatattttgttttggaaaaaaatgataatatattttttctggcatttaagtcatgctaacttttaaagagaaacagtagacttatacttgtgactccagttttttttgtggttgacatttgatatttttagaaatagaaaagcactctataattagatatttaatctaagtacttctaaaaataatgggggagatattaatttattgatactgtaaaaaatgttacaatatggtgaatataaaaattattgaaatcacaaaatggagttaaaatgtcactagttccctctcggatgtgtttcttttacattgaaaaaatgcttattcactaaatcatactatgcatatatatcataaaaatatagcttaaccgtatcatatatactagatatatgtagtacatgcataaatctagtgtgtatgtatgtgtgtatatatatatatatatatacacacacacatatataggtacagtttagaagttatatatatatgtagtgtaggtgtaggtgtgtgtatatatagttttgaatgtatacacacaaatacacagatgcgttgttgactgggataggttctgataaatacatggttaggtgatttcctcattgtgtgaacatcttagagagcacttacaacacaagcctagagagtatagcctactacacacctaggctatatggtatagtctgttgctcctaggctacaaacctgtacagcatgttactgtatggcatacttcaggcaattgtaaaacaatggtaagtatttctgtatctaggcatagaaaaggtaatgcatttggctacaacattaaaatggctacaacatcactaggttataggaatttttcagctccataaaaatcttatgggaccactgtatatgtgttcagtcattgactgaaacattgttatgctgggtgtctccagacctcttaaagtctttatatatataaaatatataaagtctatatatttagatcctctgctgttggcagcataatatacagtcatgtgctgcataacaatgtttgggtcaatgacagatggtatgtacaacagtggtcccataagattataatggagctgaaaagttcctattgcctggtgctattaagctgtcctaatgtcatagtgtaaagcattcctcacgtgttttttggtgatggtggtgtaaacaagcctaatctgccagttgcataaaagcctagcacatatagttatgtacaacacatatcacttgataataattatgttactggtttatgtatttactatactattaatcattattttaaaatgtggttatgtaaacaaagttaattgtaaacagcctcaggctggtccttcagaaggagatgatagcttcatgcatgttactacataaaattgtttgggataataaataagataacttggctgggtgaggcggctcacgcctggaatcccagcactttgggaggctgaggcaggcggattacctcagttcaggagtttgagaccagcctgaccaacatggtgaaaccccatctctactaaaaatacaaaaattagctgggcatggtggcacatgcttgtaatcccagtactcaggaggctgaggcaggagaattgcttgaacccgggaggtggaggttgcagtgagccgagatcacgccactgcgctccagcctgggcgacggagctagactccatctcaaaacaacaacaacaacaaaaaaaaaacaaaagagaatttatataatgcggttggtatatggtaggcccttactaagttgtcctttccttttctccttagctaggacaccacatatgtggtgcagatggtaccctgcacactggcacttcgctgaggggtgaatgggtgctgcagtccagtgtgctctcatttttagtaagcctaaagccccagtgtggagctgcattcacactagcctgggttagtggtggccctgcccctagggctctgaggttgagaatcagaagttcatccaggactgaatcctagctggccctaaccagctgcaaggtcctgggtatgccacctcacagcttggtatccatgcctcatctagaggaaatgcattaggatctgtccctaatgctaattcagatgtcatttttttcaaagatgaaatgaaatcatgtttgtgaagaaataattataaaatgaatgtattgtacaatttccattgtaatagtttttatatgcagaataggcaagatcattaaaacatgattattgaccttgagtgttatcgtttagttaggtgggtggttttaaagaaggagccaagagatctttgtgacccttctgagccagagggcagtttggtaatggggaggaggtataagaaatgaggccctggagggagtaagagatacacggaaggccactgtgaaaggcaatgattagagcatgacactgatgttgcttgggccatgaaagaagagaagtgggtactctgctcaattaaaaaaattatcaaaataaattcaatctagaagtagagataatttctcttctaaataagatttgaaatgtgtacatttgtaatagttctatttccaggacataaatattattttaaaatgtgactaaacttgccctgatgccataattttgatttcatagaatgagtacatacttcctcatgcttcatatgcagaatgctttgatttatcagctttggtatattaggacttctggcactctaagttgatgcatatttccattttaatgttaaattactgaattaattattgtatatttctgttgcttcgggtgcctggcagtcatgaaataattcttacaccatattgatgcagacttctggttaataaccataaaactaacatgagcctcccttccttttgcttaaattgagaaagagctatcagagatgctgaagctaaggtccagttaataataacctggaaactatagattaacactgtatctctagcctagaacttctactttatggtcactttaattcatcaataatcatatgcctgtttgctttaaaaaaccatcagtgtcttcatcagcttaggctgctgtaatagactgctgggtgctataccatccagtttatggtattttattatagcagcgtaacttaggtgctataccatccagtttatgttattttattatggcaacctaagctgatgaagacattaatggttttttaaagggaacaagcatatgattattgatgaattaaagagactgtaaagtagtccttggctagagatacagtgttgacagtgctgatatagcaccagtttctgttcttatagcaacagaaattgatttctcacagttatggaggctggaagtccaagatcagagtgccagcatggttgagttctggtgggagcctgcttcctgattcatagacagttaccttttcacatggtggatgggtgatggaactctcaggggtctcttttataagggcaccaatcccatacataagggtagagccatggatgattgggtaggacccaatcacctaccaaaggcccacctcctaataccatcacattggaggttagaattttaacgtattcagtatatagtgtttggttttctagaggtttcctttaaaaatgagcataagttttatgtacaaaatgttgtcaatatttttctagtcagtagtatttattaaccatattaactactgatttaggaagatttcttctttttttccttttaagaatgagaaataaactcgttatccatatatgcgcatgacacttgatatgttgaagctaaaataaagacaataatttcaatgtaagttttaaaatcttctaaccaaagtgaatgtagcaaatgtgtttaatatgatttgaaatttaaatagcagcctccagagttcaggtgtactttattctttcagtaaattgggtggactatggattcatattgagcagttgttctgatttatcttgcctgtgatttcttctccaaagataataatgtaataatgattcattaaggatctcgttacatttaagcattaaaaaaatctgcagttatccatacaaagataagaattttatttttattatttttccttttgttctccagatttaaagtagacatttggtcctgtagatagagtagggaacaagaaaatggtttaattttacatcttaagaaatacttaactttcattccagaagacttaaaggaggtctcagattccccagtagatgcaagaaaatgagtaaacctagaaacttggaaatagatggtgttttaaataattagttagcaaaatgaagtgctcgaagggttttgaggcagcaaaaacaagaggcataactaaattaggtgccattttccagtgaccccatactgatagcactgactgaatgattgagtgcagacttaggaaaatataagagattcgagtaatcagcaggtgacaagtcaaaggagtttcaattgtacaaatgtcaaaactattagaaactttcttttagtacaaacaaataccacagttaaatttctgagagagtaattaatttagtatgtgtttgtttatatccgtgtatgtattatattaaaaagtttatttttaataaattatataaaaaactttatgtgtatacttagaaactacatttattttgttttactacactgctaatcatattacagtatagctttttcataataatgccagataaaaatatctgagaatggattaaattcacattaagaatagttaggagagaaaggagcctaaccacagaaagtcaaattttagtaatctaatttttatgtggatgtttactagagcaaagtgaaattatatatacatatacatataaatatatgcacacatgcctaactgtagatatatatttatgcacatatgtttatatgcatataaatatgtttatgtatatgcatagtctctgttttggagtaaacatacgcattttataaatgcatagcccataccaaaacaaaacaaaacaaaatgccttcacttcaatatgtctacacaattgaagcgatagagcatatagcaaagggagcttgtttttatttaaatgacatctgtattgtttttagtagaactaaatatggaaagccttcccttaattcagttttatctaatgttgtaattggttatctgatttatgggcacatcagttttacttagatacctgccaaaataaaaccaaagtttgctttttagaagatttatacctaaaaaaatcattattcttactacacatgaggctctatgtttgtagttgaaatgcagctattgacatttataactttataactcataaataacttctctgttttaaaatacttttgaaaatctaccgctcaaaaatctgattctgtgaataatagaaaatgcacttaagagaatgaatacaaactacattatttttagtatgtcatcaggttatattgattcttagataagtatagattaaaatcgtaaccacattatccaacattagtggtcactgtttagttgctagaagttctgtcagtagagaaaacaattaagtttgctaatgtagcaagtaggcctgaaatccatgtataccagacaaacaacagctttgtcttgctatgagaaatctgtttgtattgtgagcatcttttcagggaaatcaatactagttttttcttgaatccttgaatgcattgcactattctgtctctaaatggcctcctgtcctatgaaagaaattgaactgagttagggtaaggaattggttagtgtgccagttgtgtctttttgaactcacacacaaacaatttaaaagtctagtttcacaaacagttcttaaattttaagattaaccttaagtatgcaatccttttctgtcttagtttcagaacctgtcacaagggcactgaatttttcccccagtatttgttcttctgttttactgggaggattgttgtctgacttcattgtgtagtttttctgaggcttgcggtacattattggcaaataattataaggtctctatttcttgaccctcacatgtgattcttaaacagatctaaggtatcttatttccacatagatgctgcagatttcctaaaggatcagttagaacttcctggaacacccttggatttgggtcttgcagctggctcttactcaagaaaacctccactaagtcagggcagaatcgctcctgttgctccccacctggagtagaatgaatggagtaacacattttagtttttctctaaaaccaattgagttcttaaagactctgatctctaagtaaaatgagacatttaattatgctagtgaatacaaatgtatcaaattttactttaaaaggcagaggctctctcaaattagattttataaaaattgtttgcagaaggcctgaaacaaagtgacacaataagattaaaatcaaataatgggttaacgtatatcttaattgatatatagtaaatagggaaaattatataacaacttatagaatataagacaaaaaagcattacatgagaaaaaaggactttttaaaataatttaaagaaacatccatggtgaaaacacagttgttgtagtttatgtaccaaacaccaaagcaaagagtgtcaaattaaattgtattgattaaatcgtatattgcagtttggttattaagactggcagaaagagaccaaagcattacttgttataagtttgccataaaatttttcaagggtatttggtgaaacagaagagagtcatctgtatagagaggaaggatgcagcaattgactgtatggcttctcctttggccctcacgctgttgcccttgactctcctggcacaggtatggtctagcgatggtcttcactgagctgaaagggaggccaaatacttgcaaaattggaatccatttacacattggtgtccgtcaccaaacacaccaaacatcaataagcttctcttagaggttttttgtttgtttttaaacaagtgcataattttcaaagctgctttctcatctaggaggaaagagaagttctggggctccccaaacatctttacctccagcactctggagcttaagaaagctatctcttcatatttataaagcaaaacttttggggaaaaacaaaagattagggccaggtgctgtggctcatgcctgtaatcccagcactttggcactttgggaggacgaggcagacagatcgcttgaggccaggaattcaagaccagccaggccaacatggagaaaccccatgtttactaaaattacaaaaattagtccggtgtggtggtgcatgcctatagtcctgcactactggggagaccaaggcacaagaattgcctaaacccaggaggcagcggttgcaatgagctgagatcatgccactgcactccagcctgggtgacagagcaagactctgtctcaaaaaaaaaaaaaaaaaaaaaaggaaaagaaaaaaaagaaaaataaaataaaataaagataaaagattaattgtgttagaaacacaattttattctgggtctttgaccacatagtttgggaagaatttggaagatataattaacatggttgaataaatttctctaactagaaagagcatagtttatattatctgaccaccaagcagtaaagtataaattaatatcaaagctttacgtaagaaaatcacgggagatttaaaagaaaaatcaactttctaaattttgggatcaaaaggaaataaaaactaatcactgacaagaaaatagtggcaatgatgggataaaatatcataatgtatggcataggacaaaactataattaatagacaaattttaggccattttttattaagtaagaaaaagtgagaatagactattcattcagtactcaaatttagataaataatgctgctgaaataatatgaagaaaataaaaataacttaaataataaaatattaattagagacaactttaacagagtagacaaataggttgaagagtatattttaggaaaatacatgctgacaagagagttcttatttcagggtttggcagtatatttaacgttacaaaatattttagcttcttactttttttgttgttgcttgtttcctatttttcgcctcaggtatatggactcttggatagtccatgcatgaaagactttaatgccagttcatctctgaggttaaatacaaatgtgtgtgtgagtaacatttttctaaacgtagtaataatgtttttctaatgtgaatatgagagtctcaaagtagtctggaactccctcataaaaaaatccagttattgtttccactcaaacagtaaatcatcttggtagaccaaaggagaaaacctacgtggtatttttcctttaggaaatatccaaaatatgttctatatctattccatatcttaaaaaaaaagataagacaaaataaaacaagaaacaaaaatagttatagaaagtgctttcttaatagtaacaagtgattcccaagccagattgaaatatcaattatatatgtaatagaaaactactacatttttagtaaaaaataagggaaaagttgccacctccaccatggtattctggaagttctaatgaatgtattgtgtcaggaagaaaacctttgagatataattcttagaaatatgaagggaatattgccattgtttttgcaagattttatttcaaggaacagggtcgttcattaagtattgagtatctgccatatggcagttacttttctaagccctggagatcaaactgtgcacaggacaggcaaggcctgcgcccatggagtgtattatttagagtgactgtgtagagaaagacaataaggaaacaaatgaacaagaaaatttcagatagcagtctaataatttcagatacgatgtcattgtctacctaaaagtcaaaatgtgtttgcagaaaaattattagaaatgacatgaaggaatagtaagctgaggatgtaaaatacatataaaagtaataattttaaagtaattatttggaaacagttatagacaaatatctccattcatgatagcaacaaaaaacataaaatatactgaaacttaaggaagtatagaacatgaaatatatatctgtatatgtgtatgagtgtgtatgtatatgtatataaatgtgcaaatacaaatatacacacacacatattttctttttaatttggaaaatccgtgactaaatggggcaacttaaatttctgggtagaaagatgcattgtggtaaagatgtcatgtcttttcatacttttaaaataaatgtactgttataaattaattctaacaagtttttaaggaaacttgtaaagagaaaatgacattcatctgaaatgaacattaaagaaccaccatacataatttgattaagaagagaaataaagtcacccagcctacaagatattaaaatgcatatcataaagctgcaatagaaatgaactagaaaacccagaaatcgatgtgctcgtgcagggatggcacatttgtggcacagttaccttctttccccatattgttaccatggtagacattcactagtaattgatgttgtcacatttccctgctgggcctggacgtgatctcagaactagatgaacactattaggctatcaaagttggcacgtggattaaaacattttggcaccctgttcaggtatatgataaaactggcatttaagttagtaaagaaatgaagggttatttcagaaatgattctgggaaaaactggctctttggagaaaaaaatagtcctttacttcacattatatactgaaataaattccagatggatcacaggattgaatgtaaaaaaagaaagcaggaaaaagcttgaagataatatagatatgcatctaacattaaagaaagcttttttagcatgaaagaaaaggaagaaatcaatacaagaaagaactgatgaccccgtctctactaaaaaaaaaaaaatacaaaaaattagccggcgtggtggcgggcgtctgcagtcccagctacacggaaggctgaggcaggagaatggcgtgaacccgggaggcggagcttgcagtgagccgagattgcaccactgcactccagcctgggtgacagagcgagactctgactccgtctcaaaaaaaaaaaaaaagaaagaactgatgaaattactacaacattttaaatttctttgtcttaaatgtactagttacaaaacatactgggtatgttttacaatgttttgtaaaatattatttggaagtacacataggccaggcatggtggctcatgcctgtaatcccagccatttgggaggccaaggtgggaggatcacttgaccttaacagttaaagatgaatctaggcaacataggaagatctcatctctacaaagaataaaatagttttccaggtgtggtggtgtgtgcctgtggtcccaggtacttgggaggctgaggtgggaggattgcttgaacccaggaggagaatgtggtgacccgtcactgtgccgctgcacttcaacctgagggacagagggagatcctatctcaagaaaaaaaaaatgcgtacactcaaaacatatacatatgtactagaaggattaaattgaataatgctaaaatatttatagtcattttttaaagattgagatattacaggttattttattgtattttttactttctatattatttaattctgaaagggagtgcctgtcaaaattatgaagggaaacattggaaactaatatttttcaatatcaaatattcaatattttttccttagcttatttttgaattcccttaacagcttattgaaatacataatggcgttctgcttttaaacatcagtaagttgagattcagggagagcaagtaaatactccaaaatcactgatgcagaaagcagcagggttgtgactggaaaccagtagttgagttatcccataagccattagccagcatgttatggatctctgccctgcttgatgtcaggattggggagaaaaaagaaaaaaaaaaaaaggttaagttcaagtccaggcctgatctttcatcagcagaagggggtttattttattctactttctgtgtctgctcctcattccatcccagtagctcctattcagtccttcaaggaggtgattagatagacacatttctcctgtgaaggatgttaggcttttgagacaaaacatcacagttggatgtaaagtgagacctttctgtttctatttaccttttgcaaatgtgagactctgcctgagataatccttcaatccttcttttcctggcccaccaatgtgtaaagcttggattcaagttggtgtggatgccaaaagtgttaactttgaaaaagaaaagatttatttccttattatagacattcgagaacccttaattctatgtgtgataggcaccttactgcaaaaagaggcaaagtgatggaatcaaataaacacattacagctccagataagaaataagcacttctcaaatgcaggaatgttttaagactgttaatgatactagataggtgtatgttcaataacgttcttctcacagtatgtgtgcttctaaaatcatatcattttcctttgggataataacaccataagaaatgaataaagttgccttagtatgctagtgaatgtagccagttttcaattttggtctgggatatgttaacccactaaagtaaatctgagtgtattttggaaagatacatcactatatcactatagatacattgtattgttttctggtctgtggtagggtctttcccttcctcttctgttgacaggagagtattatttgagaacatctaatcagatataacaattttcaaattgactaaaataagggccatagtcatacttacgatattgttcttctggaactattcgctaatagccatttctcataaattggctttagaatatacctctaaacaacatgatagtgaccactttattgcaaaacaaacccaatgcactgaatctttttatttttaaatacattttataatattgaggtcattacaggcattctctaagagctggaagaaaaaatttcctagcataggacctgctcagtatgttatagagtggacgatatttaatttcactgagctcctttccttcttcccagtttgcttgtcaaaaaaaaaactcacattccatatacccaaaactacctttcaagctgcttttaatgtttaacgcactctttgtttctgcaaagatttagcatttagtatttagatgattatacttattcattttctatttcttctgatcattgtgcttttgatttcctgatatatctgtctaccccatttctctctggtgaaagccattcaggctcagcttaactcatcaatgaagctctccccgatccccaactctgaactcccatagattgcttgtttgcacctctgacaccatgtaccttgtatagatcttttcataagttaactttctggcagccccataatgtgcaccctgggcacctgcatcatatatgtgcagttttctcacttctttatggttttcatttccttgagtaattccttactcctcacctcacttggtttgtattttctatcaactccagttttagacctttaaatgaggtcttattttcattgaacttgcatagaaaatcttattttgtaatgttattttgcaatggcctctctaagacaagccttgtggcccccctatgcatgttacttaataccttttgaagccaaaacaacctgaggccacaccctaacttgaaacccaggtcacgctcgccttgaaccttcccacttaccagtggaggggaattaaacacttacaagaacatcgcatgtaacattacactctatgaggtggtcccccagtcccttttgtgcagcctagttagagtaatcaaagcaactcatcacgattaaaccatagctggaaaagagactgttctattgctatagtttcaagcaatctattcccactcgtattcagtcctcagagaaaagaagattacacactgccttcttttgtcatttcagctcttttactgaattccactaatggaatttagtctggtctcttgggatacaccacatggccaaattcattctctgcttttgacagaaatatctaccatggattctctcccttcagctctctcttaccattttcttcacctcccgcaatgtggcagctcatcagtgtttttatgtctttgtaaccctcttgggtctggcctttcatgaagattgccagtctcagatctgcctagttctgctgatagataaggaatatggagcttccatttctgaggataaaagaagattcgaagaggaagagtatctcctgctcaaagagggcttgtctctctttgctttaaaaagctcccatttttataagttgaatcttttctatgtttcagcatgggctggatcaaggggggaatctaccctgccacagctttctgtccatcactattcttgttctatttatgtgtagattttcagccaatataatatgttggtacccagtgaggagttttgcatataaaaagggctcaattaaatgctggattcataatcctgcccatttaaaaaaagtcccacattttattctcttttgctattatagaatctgagtacaattaaagctttctccaaattgcctgtgttgtatttctcagtcagaagcttgcaaagaatattttaaacagttgtcgtgtgggcttttcccgaaatgccatgtcactccaaaagtgatactctgctattttgactactcatagaaaatgaggaaggaggtaggctgaacagagagaaattccaactgaagtagtactcctagccaagccagtggtatagcaccattgctcatctttagaattttagaaataactaaggcagtatgtacttttaaaaaccttttatttcagtggcaaaataaatgattaaataataatatcagttggtatagggataagcgaataaaacatctcatttcttgatattttttatatgaattccaatagtgtgatgtggttatagtctttgttggggactgtgtttgtgacagtaaagcaataaattttattatgtcattatgtgaaaaacatcttaacattttttgtgtgtcttaaagtaggttacagaggacaaaataatctgtggagagaaaaaaaaaagaaaaaagctttccattcacgttagattgcagtaacccagtgatttcttgtactttaaataatttctgaaattttagttttaaattctagtaagaatatttttaaattatacataggatctatgtgggcccatcttatccaggagagagtttatttcacatattcatgtaggcttgttttacaaaaacgacgtaaatgttatgactaaaaaacaccctgctatatttgtacgtgtggctaagataatcaaataagaccattcccaagttgtccctagagtattttatttatgttcccagtacccctgccatgactccctgagaggttctcccttgacactgatcctccttgagcacatctgaagtagctggtagggaaggtgtccacagtgagggctgtgtagctttcagagcccccatcccttccatgtaagtctgaagccccaatattgttttgtgcagcctgtgaggatagaggagaagggaaggaggaagtatttttgagaactagtttcacagtgcttttttgaaattttaatcagagagtttgcttttttaaaccatagacttgtagtttcttagtactttagttccctcagaaatttaacaggttctgatatattgcttctagtcagttccgtgaccaggaaacacatgaaaagttgttctaaatgtagttcctaactctgctctttttctttctttccatgccccgtgcttctttctctactcagtggtggccaccttgagtccatctgaaacaacagactgggggaattggtggggtggctttattcttagctacaatactatttttgttacagaactaagtcttttgtgaattgggaattttaatggaattttgtttttcaaagcttttatatttatttttgctctttgggaatcagatgcagtgtaatttttcagctcttcaaagtatcaaatttcttgacactctcattccttttcatttctagttaatttttgtctgaactaacctttttcttgtcgtaccttgcagtcagtggcaaaaatcaacaatatataagaacatcatggcctcttgaaccctcttgttcgctgaagctgcagtttcactaggcaattggattgcctttcgaatagctgtaggctttagttttactgaatgttttttcattggtatgagttgccagtattccagcttgttttgtctgtttttttgctacctgattttggccactaagctaatacttaagtgttgagcctttgttacagtcccaattcatttcaagttgtcaattcactttctctgttaagctaggctaggagtagtagcacagagaccacaaaataatcagtggataatcacaataatattttatttctcattcacgtaagagtcctggagttataggcatttaggacagcacagcagctctcctgtattcttcagggccctgtagtgatggtagcttcgaaatcagcacatggcttccagtgttgctcaggatgtctgcatcccaggcactagaagggaaacagcatctggacgagtgctcatggtcattctgtaaaggctagatctgaaatggcacttgttacttctactcacattctgttggagacaaggttgtcactttacctaactgcaagggaggctgggttgtatatggtaggaggagagaaacattagtggctggcttgtggtctctgccacaagatgatgggaaggaatttatgtatgtcaagtatatgcataagcaaaaagaaaatgtttaccttaaagacagttggacttaatgattagatgataagggaccaaaatatggaaaaggaactgtgaactaatcattaatatcatgtgatactctgaaagagataactattttgattttctaaaaatgcagcaaaggcaaagaggggttaataaaagttggcttctgggattgtatactttagagagtgtgtgacttcctgaggatacagttttatatttattttggcattttgtgaacatgactaacatgttctccatacgcatcaattagtgtagttgttctgaaaaaataagatatttttagatctcagttgtgtttgaccctagagaaagacaacacacacacacacacacacacacacacacacacacacacacacacacgtcgtagagaagggaagtaatgggggatgaggcaaggggtgagaactgaacatttatttgttcaaaggtttgaccgtgattttcttggcttttgttaggaagaatatagctagatttaaaagtaattctcggataatgactagacacaattcagtagtgtttgcatggctcttggcaactgatcactccctggaatacactgagagagctggagagggggtttcagtgcctgctcttaggtttttcagaattatggctgagatcccagtaggtcagcaaggtctgtctctcacagcaaccattggttcctagaaacccttagggtttacttatgttcttgaatgtttggttttattcttagttcctgtttttccttcctgtcacatcctagaccaggccactttgcatgtcattcttgagttctgtagtagtttggtacaggctactcctctctttccacttcagtatattctgtgtccggctttttcctgctcataaaaccttaaattactgtacgttgttcaaaggatatatttcagtctgtgcctagacaaagcctagtccagcagccagaagtcttcagttctggccccagttttgccactaactagctgcatggccaaggagaagtgacttatgagaatatatctgtccccagcttctctgtgaaacaataagcattctaaggaagattagaaaacattgtgtttgggctgggcatggtggctcacgcctgtaatcccaacagtttgggaggccaaggcaggcagatcacttgaggtgagtagttcaagaccatcctggctaacatgatgagatcctgtctctactaaaaatacaaaaattagccaggcatggtggcacacacctgtagtcccagctactagggagactgaggtgggagagttgcttgaacccgggaagtggaagttgcaatgagccaagattgtgccattgcactccagcctgggcaatagagtgagactccatctcaaagaacaaagttcagccaggcgcggtggctcatgcctgtaatcctagcactttgggaggctgaggtgagcagatcacctgaggtcaggagttcgggaccagcctggccaacatggtgaaaccccgtctctactaaaaatacaaaaattatccgggcatggtggcacgtgcctgtaattccagctatgtgggaggctgaggcaggagaatcactggaacccggaaggcagaggctgcagtgagccgctatcgtgccactgcattccagcctgagcgatggagcgagacgccatcccccccccaaaaaaaaaagaaagtaaaaaagaagagagaacattgtgtcctacatccttttcttggccatctgaagttgtatagtgatatattttagatgtttcgggaaatcctgtcacaaagtgacctgtttacctgcattaaaccttgcatagccttcaccaattggccagcaaaaccttttgttcacataacatattaacattccacctccacacaaatagtgttacccagaagacacacttagaaataatgaactatgttgaggatactagagagcttctgaaaatgtctccactttttcatctttatcacctattaagaatggcagctttgaagtaagatgcctggatataaacccctcacttagtacacagacaattttgggcaagttacttaatctttttgctctctggtttcttcttctgtcaaatgagggcaatagaagtttttaccatggggttatttacaggattccatgagttcacacaggcctagtgctcacagcagagcctggtatgtagtaagcattgcccattatcaataggcactttgcctatctcctccatggtgcctttcactttcccacactttacttttacttgtatctttcccttatgtaaaatgacctcctcatcctcataatttaactagcaatttctttaatgaggtgagcaagacacagtgaaaagagagaagttttgagtcacacagatttgtattctcattctagaatgaccatttacaagttgtattacctgagtgagttactcagcctatcttgaccttagattccctggcaatctgggattattataatatgatccacaagtgtgctgtgaaccttcaggtacatgattatacattctctttctatctctgtctctgtcactctctctctctctctgtctctctctctctctctctctctctcacacacacacacacacacacacacacacacacacactgtctatatctaatctctgtctctctagatagatggatagatagatggatagatagatagatagatagatagatagatagatagatagacagatattcttaatgggtgatgctaatgatgttaaaatccgttactggtaaatataggtatttggtaaatgcaaacgtgatattcttataattattataattattagcttaaatcctgttctcactctggcaccttttctgacatctgcaatccaactaatgcaattttccagagaatggtaagagattgacctctgtgtattgcgcatccagatcaatttattattgatattgttagtattttaccttgtcatcaacaaagtatttgagttatacttttatttttccagaggacatgatatttcattcttcacatgggaggggtcactcagatatgatttagactagaaagaaccagcgagggctaagggaagcagctgaatatacttttcctctcaccctgtttatttgctggacttgacattcagagttaacagttcactaaaaaggtgtgaatgtaggtctggccatgactggcaaaaaaaaaaaaaaaaaaaaaaaaggaaatactaataaaatagacaaaatttcaccaagatttttaaagaaaataattaagtgtggagggatgtatgaacattattagaaatgggaatgggcagaacagtgattcacttgtgatattaaaatcttaagtaaatacaaaaaaattgctgatgattttaaaaatttagataaaatggattttttttttttaaaaaaacataaattggctcaagatgaaatagaaaatctgaggaacaataatcactaaagaaattaatttaggctaagaagaagagtgaattaaaccagtaaagtttataagaagtatcctggacaagagaagaaacataaaattggtcaaaattagaattaggaaaaatgtattttggaggagagataatcttgaccagataggatcagggaggttcttttcaagatggattagacctggatagtaaaggagtagagggaacagaggagatttgcagcaaatgcagcaaaatggtcacctgttttaaatcaggcatgcttctcctactatttttgttacttttctagatatttgaaatatttctaggtttaaaattaagtttttaaaaggatggatgaggtgaggcagggagggggaggcatgtagaactgtgaacagaaagactcatctggagtcgatttttgtttagaagtgcaggaggaaagtgagctaaaattaaagccacagaattttagagtattatgggaacctcccatttcccattcctgctaccctgacagagctgcttttaataccctagatgctgaaagcttaggaagctttttgattttttgtgttttgtgttttgttttatttgttttgagtgaaatcattttggccttccttttcttggttatgggaaattgtttcagtgaaaatttcctacaggctgcttaaaagccacgcacggaacaatgggccttgtggcaagtgaattgcgtgtggggaagtacttagagtttaatgtgagttatttttatttccattcatagacatgtctcagtgaagttcaaattatcccttggacaatagaaggcagtctgttaatttaaagctagacttttttggttccataaagccaaatttaggattgatttcaaaagctaaataaacaacagtctacctccctattaaaagtgagtgtgtcaggtttctgtgtaccttagtctttaaataatgtccacttagcatttctacaaggggccttaaatatttagaaagaggctatcctttacaattataccttgtttgttaaagggacactcaaaggttggggctgtcttaatcttattactaaaattctgtaggtgtcacatttattttaacaaattaaaatagaggctggaaaagttagggttattgcaggtggtgtgattggaaatattaagagggagcatcgtctagaatccttagagatattgctcagcatcattttcctacaatgccataaaatattattcttaaaaattgtcagaggaaacaaatgttacacttcctaggagtgcttctgaattttgactcttaaacagaatcccctgtggagttcttaaaaagtacacatattgggaccctgttttggaaattctgattcagtggtccaaggggactgggcctgggtgtgtatgcatgtgtgttatgtgtggttttgtgtgtgtgtgtatctgtgtgtggaaagtttcacaagttattttaaagtatatcttgaggatcaagggctagtacaatagactacatttcatttctgttgaaattcattatttaagaactgtactctggagatttaccatgtcaggctgtaacaaggctattgctttcaagatggcaaggtaaagtcttagccgaactgttgtatggaggagcgtgtcatttctgataccaaaggacactatgcaggccaatcagcaacacaattacctatgtatttattaaatagtttcatattttagtttgaaatttttcatttaacataatttaacaaaataagacaaaacttccactgagttaaatacacaagtattcagacatttaatagtattctgactcaatatgatggtcaatgtgatttaccaaaaaatttcagtaaaaatgataatatcgtaattttacaaggtggatttaaattgatacttgcactgtttgactttctaccaaaataggagtacctggtaaaatgctgtggtgtatggagacagttatgagaaactggagggaggatgatagttgaggtaagttcaggctttgagtcacggttcttccaccagctgtgtgacctggcaaatagtttaaccttaaaatagggctaatttttagcaacttcacacattatctcacttaatactcaacttgactaggtaattttgagtatttaatgagataatgtgtgaaaatgcaacataaaaattaaagcagtataattaattgtttggagtggactccctttgcacttcttctctattggaattaatgcatgtatgggactatcatgtggtaattttgtgcatatagattgtggaattgcagaataaatgaattatggcagacattttcacatttatatttttagtgacctaaggcttcaaaaaaaaaaaaaaaaactagatacctccccactcttatgggaaggagagaattctttgttagagtattctcaagtttgattattttttcctgagattggatttctttgatattatttatgatcacaacaaagatacattttatgtatcggaaacttgacattgccaagacatattagactttttaaacatgttacctttttaaacactcaaccactgttctcccaaggccgttaccttatttcagagaaagcctaaagcctttaattttacctcaaaaagttttgatctgtagaatttcatgttgataccattaacatttgatgccatttttctatgtgagaaaaatttaggaggtagctaccttcttttgaaagcctatatattggcctagtagttgattctgttttaaattatgttttgataaattataatattttgaaattacactttttattctattaggaaggatgtagggacaagccagtctttttatatggtttctagctgagtagattgtcctgccaatgactctcaaagtgtcattcccttcccttcccttcccttcccttcccttcccttcccttcccttcccttgccttcccttccttctttccttgtttccttctttcctttcttctacaaatatttaccgagggacattgtgtgccaggtactataataggcactggcactgggagtagatgtgaataagaaacacaaactccccactcatacagaatttacattttagtgaggaatatggacaataaataggctaaaaaacttataagatgattacagaaatgaaaagaactacgcaggtattggcaggatgctgtagaagggtggagggatagtatagatgagctcatctgattgcattcagcacaggatatatagttagtttattaatattcccaatagcttggaagcaaagaggagttgatattcccccctccccaccttctccgtatattctcctctctaacttgattttccattttaggctgctcttgattttttacttgaattagattctatcctggaaattgttttaagggatagaggtcaaggtgttaatttttacccttgattgtcactgttaagagacaatgcccctaagtttcacactcctttacgcagaccaggcttaaaaattccaggtttctaatcagcggtgataattgtgtttagccaatatattaaagactgctaaatatttggaattttacatgggaaaaatacttcagttagcatgtttatcccacaagttctcctgattccttgttgccgattttgatgggtgaatttacttgggtcaaaggttgtcattgtgttgtaaaacacatttttgttttttttggtttacttgtttgtttgttcatttctttttgacttacaatgtaataccttctctcccaataccgattgctccccacccttgccccagaattcagtcttctgagtgagagaaatccactctatgttggaaaaaaaaagatcatcgtcgactcctatctttaggcagatacaaaagggtattgagagaatagatttagggtgcatgagaataggtgattaagggatataatggatgtgaatggaaatagaaggcacacagcttttaaatgggtgaagatgtgtggacgagagaatacgggggcagaagggagtggtccttgtatattagtggtcatatagtttttgtttttcaaagaaaggaaattgacattgacatattagcactaagttacctaagaactttgttggtaaaaatccactgtattttcaactcagaatgcactgagaggcatcaaatgcttttttattacagaaagaaaaacatgtcacaaaatcttgaaggggcaatctgaaatcaaagctcttcattaaggcaaatcagcatagggattattccctaggcaaatttttgggagatggatcgtacactttattcactgttttaggaaaatgtaatcacccctacctcctgagaaaacatttagcttcccatcctcccagtgttagtgggtgtctttgagaatgcaaaattcttttaatgttaactaaaccagacatcattcagaaatgcaatctgctttttaaaattcatgtaatatatggaaaaattaaaatataagtgatttttaaacattctgccatatggaaatacattctctatgacatcccttctccattgcctgataacaaaaagccagttgtagtgaaatttacatcagagtttgaaagacagaaattccacattcctgagtgttattgaccctattggtagtattaaatcagtcaggagggccagagaaggggctggcctgtggtgtcattttaacaatgtcacaaagtagcagcctcccaaaccaggtattgtctgtgtatttcatcctaagaagcgggagctggcaagatcctgaccctcattgattcagccacatcatcttacagatgagggatctgaaacccactgaggttcggagatttgtccaaggtttaaatacccaacctgaaattccaagtttattctaaagtaaatttgtattacagggtgttatgatccatttctaaacccgaatcctagaagtcatcccttgtagcttctacttatgagtattttccacaactgcttcaaagggctgtccttcttcaactaacagtatttcaaaataagcaaaaactatttaaagcacaactcagaaaaacatagactagcatgatttaataatgaacaatatcagtttttcaattgattccatatttttctcagattttaactgatgtctttgtattttccatgtagaaaagaaggtatgcttaatgtgaacattgtgaaacaaaataagattttgttcttgggaaacccttttacttcaaatttcagaaagtaaagcactgccttagagttgagtttgtttatttttgttttgtttttgtttctttttgtcttttatagcttacaacatttgcctttttttttaacctggaaacattgtgatggactttatagttccttagattggacaagtggaaagatacaggattgtgcgtatgagcctttgctcaacccagtgcttgagctgtgttagcccattgaattctttaagatatatttcagtcataattttacatttaaatatggttaaactaagtttagccaattctgatgcatttttaaaaagaatgtgctgttgagctaagactctatatgctgtattttagccccaagcagatttttatgacaaagtaataaacccctggaaacatgtttataatggaaaatgcaacttgaccttaactagaggaacccaaatgcaccttacaaaaaggctcattttttttttgaaacatacgaaatccctttctcccagaggtggtgtcacaggagaaaggtgtataataatagttgtatttaccataaatacctaacatattttatgatgatttgattgtattaaaaaatttcaccttatagattttaataaagctgcctatgggcaaagttattgcagttggatttcttttcctttgcccactgctctgtgtggaaagaagcaagcaacccttataaaaggctttagtttttagtacctggttaataaaaaataatttcctctcctttggacttgttcatgaagctgaaaaatgactctgcaggtcagtggtgtgtggcaaagctaatttctataagctttttatcaggtggtactgagtaaaacaatatgggaaactgaaaaacccacccttctgtaccagatttacaagggtgagggttatccccagtgtcacaaaaagaaaaaaaatgacactttttcttcccaatttctggtacagtaacgaaaaattctgtgttataaaaggtacgaaaggaagaactaaattgtatggaggtgttcagctaaatttagattttaaaattcggacacaaatggcactcattgtttaaagcacagtaaaactcaactttcatttgttgttttgtcgacaagggaatctcatagtaataggctaaatgaggcaaggcacatcatagcaaccaggaaagtgattgtcattcaaataaatatgcaaggcttcttttccccaagcatcacattttctcagaggagtactaggaagacattctaatcaagagaactggagctgcttcccttgaggttcagcagagtgtttggtgtgtgctttgcagagcatgatagagaaatatcacatccctcctgtctctccaagatattcacaggccacattccaggaaagaagctggagcagggctgcataaggctcccaggcacctgtgtagctggcaaatctgctcccagcaagcttgaagtcacattcttttctttagtttttcaggctggggaacagcgaggatgcacagcagcaatgtatgcttaggaggtcacagaacccttctttactgtccttgtgtcagggtacctagggccttcttacactggcctattcgcatcagagcccaaaggaaaagtcagaaaccacaggaatttggagaggttatgggtgagtctttcttttatgatttctattttagcagctagcatggagacttgtagctgacaacattagatggaagaagtaccatgctactttggagtcatgtcttagatgaaggtaaagagagaaaaataattataaggactttggaagatacagactgttttcccttatttagtttagtttaataaaggtaaaagcatgcgatgtgtaggtgtgagagaggttttggattgtaagggtagaaatacgtaaaatttccaacataactgctgttcaacagctgtatcaatgatttggagagtgattgacagggaagaggacatgttttactacaatactgaagtggaagacagagatcaagatgggtgtggtctcagacaagcatgttgctgtagaaactgggggttggcagtattccctcccaccagatgacttcttggtttcactgtgaagttggacatggggtcatccattgagaggatagccgggaggtatgaatgggaacttgaaaagactggatgaggaaggtggacagtttctggaatgggagcagatgctgaaaagtggcacttagaaaagttgagaaccctgcatcaatttatacatgcaattatgtgagtcaaatagaggaggatgaagatgaattaggactctactggataggagaggcagaggaacaagaaagtagatgtacgatgaaagccatgaatcctgaggcccagaaaaggaggaacagactacagtgacattccccttcaaaaactggagattgaatcctgcaaaccacgtctgcattttgtgaaacttactttcctcttaggttttctttaatggattgaggcctgagtgtttagattgagctatcagaagctaaataaacagtagtgtaatttgcataagctagtctcagatgccttagttgtggtataaaaacgcttgggaaactcatctaaatttaatcttttgtaggctgtttatgggctttctggagaaaataagtcttcctactttttgttcagctttcattacttttaatcattttggtcatggcatgtcaaaggttttctctttgaaaagtgcttttagttggtatttttaatgaagtgttatccacttaaagtgtgatataattgtgatattacagctagcagggaacaaaacagcttgatagtcacttccagggctccttgagaaaaacttatactcaaggaaaggtcagctcctctctactctgtatacatcttttgggctcacttttgcacagctgctttgcatgattctatggctgtttgcctcatttgaagatgcagttgggaagaggagcaaagagtggctatgctggtggttggggtggccatattctgcaaaacaccgcattcttctgggagctttgcactttgcatgataagacttaatctgtccctttcaatcataaagtggcagagctagggtatactgtggtgatcatcatggtggtgatcatggtattcatgatggagaataacctcaatgcctcagcagaactggataggtaattttctcttgttataattgtgctcaacaacctgcattggtttttgcctcagttacatcatgtatagagtaaacttaaatgcatgagctttcaaaaaaacccatgctctagtcctagcctcgtttttatttttcttccatattctgctacgtacagctctcttggccagagttactactcatagttcacaatctggtgttacctgcctctggtatttttttatacaggcagtttctctggccctctttccattttcttctatcaaaattatactcattctgagaaacacaattcgaatataacttttgttgatattctcaatctgttgttccctttttcagctcccactggcctttatttgcacactgctttgtggcacttctcatatccacttcctgatttatgactgtttttatacttgtttcattcttttctcaataatctattttgtaaatgccttcagtacctttttgagaaaggaaacaactaatatttgttaggcactgatcttgagttaaacaccatggttgacttggagggggtggatacaatgaaaaataagacttatatccctgttcttcagttctcaaggatcttgtagtctaaccagaagtaggacgggttaacagatatatcaatataatataataggcataaaaatacagtaagctcaaattgttctggaaaacagagtaagctgtctatcctgggatggagagctcaacaaaggcctcctaaaggaatgaaatgaagtaaatcttaaagactgagtaggaatctttaagccagaaaaggaggaggttctgatctgaggaaagagcctgtgcaaaggcatgagacagtgtgggggatagagaagccattaacttctcactatcaatgtagtataaagtaaaagactgagtgaggtgggtggtgagctgggagtgtaaaacagggaccagttcatggagggttttgattgccaagctaaggagctggacttttatcatgaatgtatcggagtgccctcagaaggtttcaggcaagtgagaggcatgataagatttctgggttggagaactcactctggtagcagtgtgaataatgaacatagaggtgagagactggttcatatgtggtattgctgatggttgggatgaattttgtatgtaaaacagttgaatgaaaggttgctttcaggcacttctttactggctaggcacctcttttaagaacagactcaataaaaagccatatacattatattacccttcagagaaaattttgggtggcatagcaaatctaaaaaaaatccacaggaaatctgatgttctaaacagagcgattatataaaacgctggctgtggcttaagcaaacgcaatcacagaattgcctagctgtgagtcagagtcggcttgatcctgaaaagtcccttgcttgatagtaaattagtggcttagggaaatatgtttacatttcatttcatattgtacatctgattgcatgttttgagaattggatataaaatatctttatttacagatttggagctgggaattatattgactgtgtgtacatacagacttaaatttcccagttaagtgtataaatacagtgaggtatatacttacatagcaagataatgctaatttgccattttatctcaaatagaaacatatccaagatataataatggaattcagtgactcttacggtaaagtcatcattactatagaatggcatactaggtcttatgatttgatcaatactaatttattgggggaaggcagaacaggtttaactatttttaactatttctttccatgtacttccatatttctttctatcataaaatcgaaacacgctgttgcacttgttattttcctgggtcttttttctatattcaaaaatacacctgctgtgtatttggttgtagcatcagagtctagcacagtgcctagtcctagtaatttctccatgtatatttgtgagaatgaaatggcaaaatgaataatgagtaaatgaaaataaataaatgcataaacaaatacgtaaatgaaccctaggtaggcttggctcactcataaacatttattgagtagctactatgtccaaggttctgatctggtacaccatggtgagcaaggcaaaaacagttcttgccttttgagttcttgctttatagatcaagacatatgttaatcaaatagttatagaagaaaatatgtaattaagacatattgtaaacattgggaaagaaaagtagaacttgctatgagtctatttaatggagagacttaatctaccctgggtagggcagggtaaataagcttctgtgaagcagtagtctgcaagctcagacctgaatgagttagcattagttccatgaagaggggcgagaccttgtaggcagcagaagagtcttttagagctctcgaggaggctaggaatgcggcatgttggagaaactgacaggccaatgcagaaaagaaaaggggagttgaccttaatcagaaatcaataaggatgaggcaatacgtatcttcaaatttcttctttgaccacatgtacttgtcatataaaaatacaaatataatgtcgtgtaatgcaatgatgttatattcatatttaatatctagttagtccaccaaaaggtatctattgattgacaagttgaaagccagcaaaaatgtaagaggcatcctgtctttaagaggtatataacatacataggcaggacaaatgtaatgttttttttaaagggaaaaataataaatcatgtaaacgatttatcctgaatgaaagagcaatgtcacattagaagaaggagaatgagaataggttgtatattggagaattatgctaggattacgctagactgtaagttctacagggtaagggctgtgtctaacttgtttccagtgcttagtgcctaggcaggtatataatataattactaatgttgaattgattttacttcactttgtattcttgaaattagggtttcttatactattaatagttaagcttagaaacacaaaatacagtaaatcttcacttaatcattgataggtcttggaaactgcaactttaagagaaacgttgtataacaaaatcagttttaccataggctaattgatataaacaatagttaagtttctacagtatatttatggtcacaaaaatcaccaaacttctaaatacttctaatattaactattgaaataaatgtaagctatatgtagaaatgtataaaaagaaagattaataaaaagaagtacgattattgtttatctgattattctacttcagggttgtgggtgtccagagctcaccccagcagctcagggaaccagccctgggcaggacgccatcccattgcagggtgcactcacacacaccctcgcacttacttagatggggactatgtggacacaccaattcaccgaacatgtgcaactttgggctgtgggagcaaacaggaggacccagagaaagcccgcgcagataaagggagcatgcgcaaactccatatagatagtggcccccggcagggaattgatttttttcttcatcaaagttataacaaaataacattatttgaggacatgctgtacatagacagcttcatttggaaatgaaaacctagtaaactttccctagctctcccttaaaacagagctgcttcagactagttttacattcctgtttttacctaaacatgcacaaatataactccaatttctaagtattttttgccatatttaattctgcttattgattcctgttctagattgcttttcagtgtctctccacacattttctccccataatcatccccctatcttactcacttttccttccccaagtgaaaatacagcacagccagtatagaagcatctgtaacccacagtgaagtgggaatagccattttggttcctttcctcctggtattgagcaacttttgttcatcaaatctgaaaaacaatatccagcttacctgggcatccttcttagaaaggtaatggagattggggcataagaagaaagaaaatatcttttgaatgtgcaggattttcaagagagaaaaaaaaaatatgctagggaaagaaattaaggcagaactgatagtgttagaaaaggtacacttgaattttttgttttaaaatagttcaagttcagataataatttgccatcttcaactttagcacttgaactaaaataccgctttagcactttaacctgtagcataaaaacaatttaacaaaacaactttggcagattctgcttagttgcctgtggtttctagctgggtttcctgcaattgcctggcagttcctctctgttctgaccagatttctgggtaactggcctcccttcccctctgggattcatgaatcctgtctaccaggagttatcacacaaacagttagttttagaccaatcattggttgtaaatatatgttttaaatataaaagcaatattgtacaattatgttacctacagtttttagaataatgaaaacattcttaaaaatactgataattcagctagtataacatgaacaagtgtatcattttggtttataaattatttaatcgattcaaaataatatgacttttccataattgtaagtagagttaacacaaaacattgtcctactttctcatccaaacatttttataagacaagtattaggttggtgtaaaagtaattgcagttttttgcaattacttttaatggcaaaaactgaaattatgtttgtaccaacccaatcaatatttccctttttttctttttctttctttttttttatttttttcttttgagatggagtctcgctctgtcgcccgggctggagtgcaagtggtgcgatctcagctcactgcaagctccgcctcccgggtttacgccattttcctgcctcagcctcccgagtagctgggactacaggtgcctgccaccatgcccggctaattttttgtatttttagtagagacggggtttcaccgtgttaggatggtctcaatctcctgacctcgtgatccacccgccttggccttccaaagtgctgggattacaggtgtgagctgccatgcccggccttcccctttttttctaaaatacttttacgtataacttttttggatgcctaattttggtctagtaactacaccatattgtatgaaacatctctcttatgattagagttttaggttctttcatctttgttttttttctctctttttctagttattaaaaataatatagtgatgaaggactctctttatacacataaagatgtattgcttaaaattacttatgtgagataggttcccagaaataatcagatatatcttcttagataaaataaacaacttggttacatgcctggaaaataataatagaaatatataaacaatatgtctataagcaattaaaggtgtatcaatatgtatagacccagcttaggtattctttcttactgaaatctcctgatctcactatatgtatttctttctttctaaacttccgaagtctaaggtctggtccttttttctttcactccagatcttatttatctctcagtctgttggagaggattccactttcctaatcttcatgttttgttcacctatttattgagttctttgctctatatctagaaaaactcctgaatgctatccgatgattcctttcttggacccaagagtcatttgttcaaaatgttatttgaacatctctgcagtaagtatagttgttcatcagggacaaataatgttgcacattaaaatcttgtctccttatgtattgtgttctaatgtctcaagctactgtaacaaatctcaaagtggggtgacacgtttaggcaaacaaagagcctaaaaacgtatgaacagccaatagaaacaggaaattcaaagtcaatgtgcagccttctgtgattcatcagttcaccaggtaagatcttggataaaaaaaaaaatcatcccattgttcacacagtctctagcagaatgtgggtaggcacttaataacattacaatgcagtttgaattcttgaaaccctgcaaagcatttatgagttaaatgttagagcactaggatgcaccattcgatagaacaatagtaaaactggcagaactgtttttcatatgtcaattaagactgcactccggagaccattaaggaaaaggatgctgctattccccgcagttaaaggaaatctattgtgtttcctttggtctagatatataagttctgcagaaaatgtctttcagtaggttaggatctgctaagatttgatcctaaattatttttcagatagagataataaaatcataagaagaaacactttggattctaatggagtgagtttgagttctggccatattcaattgtgtgtcgatggacaaattaacctcatacttacatcgtacttacgtcgtggaattattgaggggattaaatgagatgatgtatgtataatgcttagcattatacttggcgcaaagttggtactcaataagtgttaatacttattagtatgatgattttgttaatttgatgacaaaaggggatgaattgtgttaaaatcagcaaatattgaagaaccaacctaaaggtttttcctcactagattatcagctacatgaaggcaagtatgtgttgtcttttaaaaaattattgtttctacaatacataattcttgagttatagaaggcactcaatgaaggaagagaatgaatgaatgaatgaacaaattcctaacttgtgtctgtctcttggcctttgagtatataggtattttcacagccataggaaaatcagatgctataataataattctactagctttctgacataaatcttttaatttccttcttaggaggctagttcacataaataaaacactagaaaaggaaaatagctcttcctggttctgtaagttcaaaaaataaccaatttcttaatatggcagtaattccttgtatgactagctgggctgggactgagaccaaggaccttgacactaatgggccgtttatgaaatttacatagcctgaagtcatcctatcggaatgtccttagtaaccatcaccattgttacagaaaagaattgggaggctttttctttcttgcaatgatttctttagtttttttatgttgtgggtcctatggttgagatcatggtttgggtatttacataagagcaaacagtcctagaagtatgtaataatttctaatgcagctccttggtaaaaagaatgcaacaaatgacacagatctacagcacaacattagaaaaggcgcagattaaatttgaaacaagagcaacctagtgcaaataaaacccttcaggtagcagctttttggagataatcaaatccgtttttagacttccacattttcctaactttatgccctccataaggatgtgatttctgatatgcgtttgtgtgcttttacttgttggtgacttttgaaagaagtcagccctggaatgtagttgccttgcaaaaaaattcaagggaatattttgtaggttttgctgtctatgccttggaagcaaacaaattatggtacaggactggaactttacctacttgttaattggcaggttaaacttttatgagtttctggtaccctggcgatacatgactattaaaatttgcaggtggttcaaggggagagagatgtaagttcctgtgctagtaatatatcataaaagtgtgtatttcatgtgcctgttgtgaaaatggagactttaatactctttcacagtataagctgattaaggaatctttatggatctcattaacgatgggcctttttttcacagaaagtgaaaagtgtaatgcttatagacaagcatagaagaaaataattagcttggtagtgcctctttgagactgagtttagagcaccctctgcattcccttcccaaccctcagaaactgcccttgtctcagaaattgcttctaccacatgaaatactgtaaatctgtcattttatttttactttcaaaagaccgtgtttgcttaattttacttacatttaatagatggtatgtttcctttttcgagtccatgttttcattaggaaatacaaagacatatactgtggctagtgatgtgattccacataatgaactaaattttggaaaaagtgataaggggattgtagttctttggaaactctattttcttatattttacatgtaatcttaggatggaaagctcctcaaatattggctaaattaaacatttgcccgaaaatcttagaagtagatctttgtatccaggagcatagcttgttttagcatagagaaatagtgatatgaattagctttaactaagaaaagggtagtaaagtgaacaatagaaagtattcgttttattttaaatttttagtccataatttttctttacccatttttttttggagaatttctgtctgtttctcttagtatcatcataatcttaatatagcacttttggaacactagattgtgatttagtttcttcactctcttggtaaatatataatgtagtttgaaggtacttcatccattggcacttgttgaaaaattcattctttagaaatggttattttctaaattggtttaacctatggtcagggtgatggagcagcaagggaggtgggactgcatggggccaggggatggagagacttagggacaagatgagtgtgtcatggagaagctgaggaccacaggaaggcattggcaatggacataatgaagaaagaagtaatgctggatgaacaatcctgttgggcttttagctctgacatcagtcataaaaattttgtctcccaaattggttgccaagaacctatagttctttgtttcaacaaagaatgttttctgagcgtgacaattgtgtgcatataattgtatatgataataagtatatatacacacactatttacatgttatatacatacatacactgataatgtactatattttaataaagacttgaatgacctttatggcttttgttaaattagctttgtttttaaaatctcattttaaaatgtgagacagtagtacatacagtagagttgacaggaatgtatttccttatttttaaaggatatattgtgtcaggaaagaagaatcatcaactcttttgacccagtgagatttaagaaggtgggaatagagacttttataaaagtttctgcctaaatatttttttaaattgtgtatgtactccaaatgatattcttatcaagtcttatgattaatatagctttacaaataattcaccattttaatgagggttgtgagaagcaagctcaatgttataggaaagaagtaaaaaaaatagccttatagaattataatcgtcaaggaagtatttgggaatcaaagcctagttttggaaatcatttcttgccaagtgaaaaggtgctaagcttctcagcaagaagtcatttgtagcacaggcttgtctgtcagtgtttgggaggtgctaataagcaaataagcccagagttccagcctgagtatttggtacatccatggagtgctggtgggtatcttaccttagggaaagctgcaagtcagtccacaagatttactggagacctactttctatatatagatagtccccgatgtttgatggtttgacgtaagatttttttgactttacggtggtacaaaagtaatacaccttcagcagaaatcaaactgcaaatacacaatcattctgtgtttcatttttagtacagtattcaataaattacatgaaatattagacttcttttctttttttgagatggagtcttgctctgtcactcaggctggagtgcagtggcgtgattttggctcactgcagcctccgcctactgggttcaagcgatcctcctgcctcagcctcgcatgtagctggggctacaggtgtacaccatcacacctggctaatttttttgtatttttagtagaggtggggtttcaccatgttagccaagatggtcttgatctcctgacctcgtgatctgcctgccttggcctcccaaagtgctgggattacaggcgtaagccactgtgcccagctagctttttaaaaaatagtctttgtgttagatgattttgcccaaatgtaggctaatgtaagttttctgaagaaatttaaggtagactaggcaaagctatgatgttcacagtaggtttggtgtactaaatgtaatttcaacttgcttttttttttttttttttttttttatcagacagggtctcactctgttgcctaggctggagtgcagtggcatgttctcacctcactgcatcctccacctcccgggttcaggtgattcttctgcctcagcctcctgagtagctgggactacaggtgtgcaccactatgcccagctaatgtttgtatttttttggtagagaaggggtttcactgtgttggccaggctggtcttgaactcctgacctcaaatgatccgcttgccttagcctcccaaagtgctgggattacaggtgtgagccactgcgcccagcctcaacttgctgtattttcaatgtatgatgggcttatagggttataaccccatcctaagtggaggagcatctgtgtaggtcttttactaggtgcctgtctgggagaaaatgttatttaagaataggttataaggatttgttttttcttgcacattctttattttctagccagagtagataaataaacaaacaatatatagctcactgaaaaaactataataacaaaaaagtcaaaactacgatggaatgtatcaatcagaggagaaaacagaggcaaaggtttcaggaaaggaaggcttcccacagtactataagggatggtattagtgattgcttgcacctttgttcgtcagctttgtgctatatgccttataaatcatttatttttaccatttagtgccataggaatcctatgatgaagacacgatcatactcctgttagatgaggatccggcagttcagatgtgtgaagtaacttgctggccgttgcatcactaagggactcacgctcagttgtgatttgcttcaaagcctgatctctttattacatggcagaaaacaaagtgaatgttattcataataaaaagtatatgccacatgcaacagggactcatatctccagttttcttagttcaactgtgaggtaaaaattatgtaaaaattagaagaaaaggccgtctagcaaaggaagactcttcatctaatgaaaacttgaaaaaattaaaacaatagtgtaatgaaatggattatttattttttaaaattcaaaattaaatgaatattgattttaaaaactttagaaattagtggaatatgaaacaattcaaactacattagaaacaagtgccagtcaaggttttaaaatatgtccatctttagattaactaattaaaaatgttttagcttaagtaaattgtaaaatttctctgtcaaggatgtctacctactaaaatttcatttaaaggcattcattagttttagctaccaactaaataggaaagttttcatcgcaatttgaagggtatgcaaaataataatatgtaatttcctatagatatttttgttatgaattggtatttgctgcaatgatatcaaaaaaggaaagtagagcagaaggaagcccagacgtctcagttttaatttgaggaaagagtatgtgataagtataatataccactggttctctaggttccattaaaagactgtaaagagaaagaaaagaattctttggaactaatgattccaatctggagtctatctctggatccctaaggattcaccaacttaaacattagtttccttgttgatatttttgaagtcctaatgttaatacctttcccccacttaaagatacacaagacttaagacttaaactgttgagcattttcactgtttattactacatcaacagtatgataacattgtctctcctatatgtcggaagctctgatttgccattatatgtgtctttgtttataaataatatgaaactatataattcttactttatacaatttgcttggtagacaaaatttttgaattaattgtatacatagaggaatagataataaaagggtatattgaaaaggctgggaatcactattctgtatactgtacttagaatttaggtgagtaaaatgacctcatacatcattgcaagactgaggctggtgttttttgctgcctaaaactaaagatatttagcatttgggcattagctaataatgattaactctgtggtaggtgctatatctttgtgttaaggtaaacatactttaatatttgggacttttccttgaatattgtataagccagttatgataagagatttaagtgaaagtgctaataaactcccttcagactcagaccacacatgagaaacttcccctcagaaggaaattagaaggccagagggaagaaattataagtaaatgaacggcgttttaaaactgaggtgctgtaactagaatgctgctaagatattaaagtacttagacatttaaaagacatggttatttatatttaatttcaaaatgtatttaagtgaaaatttgaaaaatatttgagataagcagaactttcagatttttttttcattttgttaaaggaaatatcctactttcatgtattttgcaaagatgtcacaatgatattgaccattatattacctgatgtccattaaaggacaaaaaaagacaaaaagtaactttaatgttttttcttatcaaataataggagacatgtctgctccttactcatccttccttttttttttttgcattggctggcaggaaattaaatttagtattcagttgaggtaaataacttatctcagcctaactacaaggacatacctttcactatgcattttatttgaattttaattcagtaacgtaagtatttagttatatttgctgtctaaaatgccttttagatatttgtaacaaataaattataagtaaacaagtgacctctgagatataaattttttacatcttgctatttccaagttacattgcctgttcttattgaataaacaggttggcagaatattaagaatatcaatgtttacttctaaatacagaaaaacattgtaatggtaggcacaaacgcttcttagaagaaattaagaatgaatataacttaagaagaaaggctctttgttatttttgaagactatcctggttgactttacatttaatggggaagcagaggatgtttgatatttttacctcaactttttttcctcctcttcctttttgtagagaatactcttacttgaaaccctttgtatttggtcctcattctctgctttccgtggcttcctacctcgcctatttgttctatggcctgtgtgcctctttcttttctctttgttagttcctcacccttcttctcattgtgttcccaaatattttcccgaattttacagatgagaaagctgatactcagcggcattaagtagcttgacagagtttacacagctgctaattggtcaaaactgaggtgagaactctaatcctctccctcctggtacactgctctttctaatggcgttacttatagtagaacacgatgctgatagactgtgatgtagttctcgatggcttaaagtgtatgtgtttttctgtgtaaactagaacccatggggctgatgttaagccagttcacactggtacaactgcgctagttttaaaaatactgaaatatttccacattggctaattggtagctactgttaggagcctctcagctgtacctcttccttctttagaggcctttagtgaatccatcaggaacctcacaacttggtccagtggcaatcaaagagaggcatttagctacccatagttggataagatgattagtgtaatacttcatgtttttataaagagcaacgctctctaacataattatctttttggtctgcttttttctcatgataataatgagagggaaaatttattctgctcaaagaatgatgatttcaggttttgctggtttttgttttttaaaaacttcatgtggtgaaacgtgcctgaacagtatatgagaatgttatgatgcagtatcaaggttttctagcccctgtgttcacttaaaattttgcaagtgtagttccttttagagatcatttaaacattttaattctgaaataactgagtatctatatatgttttgcagatttcaagtatgggattactattgttatatctttactgtattcttgctcttttttttagttatagggaattgcactgactgattttcaaatgctaaatcatctatgcatttttttgtgataaacttcacttggtcatgatgtattatccttttaatatattattggattggagttgctaaaattttatttagaatttttgcagccaggctcagtgactcacgcctgtaatcccaaaactttgtgaggccaaggtgggcggatcacctgaggtcaggagtttgagaccagcctgaccatcatcatggtgaaagcacatctctactaaaaatacaaaattagccgggcatggtggcgcatgcctgtaatcccagctactcaggaggctgaggcaggaaaatcgcttgaacccgggaggcagaggttgcagtgagccgagatcgtgccattatactccagcctgggcaacaagagcaaaactccatctcaaaaaaaaacaaaaaacaacaacaaaaaaagaattttacatctatgttcatgaaggagattactattttctgtagtttttttgtaatatctttgtcaggttttgattattagagtaatacctcattggggttaggtagtattacctcctcttcatttttctggaggagctgtgtagaattggtattatattttctttaatcattttatagaatttgcaagtgaagtcatcaggcctcgtattttctctgtgggaaggtgttttgccaaatatttaatgtctataacagatatagggctgttacggttatttatttcttcttgagtaagctttgatagggtttttcaaagagtttgtcctcttcaagttcttcaattcaattgaaaaaaattgtttataatattaccttattatcttcataatatctatagaatttgtagtaattaatgtcacctttggatctccttttttgccagtattttaaataagtggacccactgtctccttgcctatactgtttcctaagaaatactagctgtcattcatattttgtctctttgtgtgtgatttttcttttactgtaaatttgtaaaataatttctcttcagttttggttttgagtatttgattatggtgtattttggtcaagttttctttatgcttcttgtgcttggggttcgctgagatttttggatgggtgagtttatagatttcattaaatttagatatccttcaaatatttttccatcccttgcctttggtgactccagttacgaatatattagactgcctaaagctatcccagggcccactgactttttattatctaattttctatctgtgctttcttttgggtaatttccattgctatgccttcacatttactaatcttttcttctgcattgtctcctctgccgtttagcctatccattgtatattttaatctcatatattgtagttttcactctagaagttcaacttccatcttttttatatcttctgtatttccacttaacgttttaaacatgtaattacagtttcaataactgtcttaatatctttgtctgctattaacatctgtttcagtgctggatcattttcaattcgttggcttttctcctcactatgggtcatatttttctgctttttaacaatcctgataattttttttggaaaccagtcattgtgagttttaacttcttgggtgctagatattttcatactcctatgaatcttagtttgttttggggtgcagttaagttacttataaacagttttatcctcttgagtgttgtttttgagatttatcaggactaatgcagtgtttagtttttgactaattattttctagtactgatacaacacacttctggatactctactgaatacagtttccattatgaagttttctagcatggctggtaggaacagcattcttcctggcctgtgtgagtgctggtcgctgttagctttaggcctctcaggtggtactttctcttgcctcaaatagttcccatacatatatgtattaatttgcactctgctgaatagttaatagagatcttttatagatttttagagttctgtgcctgttcagccctcttgtctctggtgctctatccagaaaactctaactgctttattgtccctgaaatctcagctctgtttcctcaagtctggatggatgtccaccacgctcccccggactctccctccctatgccatcatatagaaatgctctcttggcaacaactttgcacaatcatagagctcaccacctttgtttctcatctctcaggattgctatcctttgatggctcaagtctagaatcttgaaaaccgttgctcagcttttggttttgttcgcttcagggttttagttgtttcaggcagaagggtaaattcaattcctgctactacaagttgaaggcagaacttccttgacacttcatgcagagttgaagtgggaagacttttagacttaactaccaaagtgtccacttcagagagtaaaactcaagagaataaatcctagtattttttctattgaatacacctttatatttacttttttcttttcagaaaataaaaacttgcctttttttaaaaattggaaaagtatacaaaccaaaaaaaaaaaaaaaaaactacagctacacgaacacttaaagtttttaaaaataagataatgaaatagtatgattgtgggtaatttaatagattgtggaagtgttttccaaagtcacatgaaagtatgggtacttacctttaaggatgattttaccaggccacagaacaatgagaattaggaagtttttcacaaaactaaatttattcaatttaaaggactttattttttactttgtcattcttattagtgataaaattttatgcttaattgaattttaatatgaaagctgatgaatcgtaagaatttttttttaatatgatagctgatggattataagagttttgttttttttcttttcattcattaactggcaaaagtacaagagggggtgcatgctatgtggagtccccataacatttttgtactccaatagtctggaaacaactgtttgtatacgctcaaatactttacccatttttattcaaagattgattacctaagactattcagagaagtaatgtttgtttgtttctttgttttgtttttgagcatctgccctgtacaactcatagaatctttagggacaatggcacatgtctgaatggctaacttgtgtcatctttatatgtccttttctttacaccatatagaagatatggaaatcaattatttcattaatacttaaaagcactatttggagatgtatttttaattttcattgtttcctaatattatttctttctattgtatgacaaggaaacaggaattgatttggttcctgccctctttgtcatgaacatatgaccaatgagaaaaaatgcctttttaactatgatattaataataaatatgtgtcaattattgatgtattaagtgtatcattcagtacttatagaaattatttgaagtagccacaattattattcttttacaaatgaagaaattgaggcttaaagagttaagtaactgctcaaggtttcacagcaaatgtaaagccatatatgagacccccgtttgagtcaggcaaagactgtgctccatctactgcctccaagtgagaagataagttttagtgttttccactaagcatttcctggcagtatttctctccagacgctattcacaatctccaaagaggagaaacgactctattctatgcacaatttattactccggttattatacagaactctttatttaaaggggagaatgataaattacactcttgttgaaataagccttgtagacctttgaagagggttggaaaccaaaggaaacagacattccagaagtgtgacccattttttttttaataaatcttttcttttgcttaagatctcctaaaatatttccatttttataaaagccttctggtttctttgtgaaaatagctgcaaggatatgtcactgggtaggttcattaaaaattacaagcatacaccattactatgaaaagctcctatagcctgtttcctgcacattgggaagagtgcagctttccagcgatggtagcccatgaatctcggaggcctgcacctgcagattacagactcaggtacaggcactatgagaatagcccctgttttgtaaaaacaaaaagctctgctagtctatagaaattgttgggaaagagaagcggacctgtgtgagataaacaaaactcataaaccactgagattagataaattgttagagttgtttggaaggccaggcaggaacaaacattgtcttcctaaatgtagttttcctgcacttgggacaagcgtactatctgattaccccagatgatttatttatccttctagactgttgacatgaagtctgcatttcaggcctaggaataggtgtactttctgcagttattttgtttgcagaaatcactgacttctctcatgttactttttgtgattgctagaggtaacgatatcaaagttcaatgtgctcagcttgtctgtaatagtaaaatcttagtaaatcactctaggtttgaaggataggccctggtataataatataacaataaacagagttcctgttctctttatggttttagttacagcattgtatcagtgatacttcagtttcttcttgataaagatttttcatatttaaaactcataaaattcatgctgcagggtaagtaaagtcttctgaaagcatacattcatttacttgtttattcactgactccataaatttttattaagtacccaatttctggcagacattcttgtggatcatgcagactcagtggtgagaagaaaaataatatccctgatcttacagaactcattttttaattgggggaggggcttaaataaaaggtgaataaaccaaacaagaaaatatcaggtagtgatactacccagaagaaagtaaaacaaaatgaagcaattaagtgtgcttggacacctgctttagattgtgtggtcaaggatggcccctccaaggactagcgtgtaagctgatacttgaatgagaaacaggctgccatgcaaagatctgctggaagaacattccaggcagaagtaacagctcatgcaaagatatagcataatgagggcatgcctagacatgcatcataatgccttaccttgtaccttgatttgctttcatttttaccatttaaaattctgcttctgtactatgtcctacctccccttacccttcattatccttaaaattgtgtattcttaatgaaaactatattgttaggtgaccatagaaatattgttattttagatagttgattctgtagtgttttcaagaaattatttcatatttagaataattttgcaaagtgagttagtttaaaagtagttctttaagaaacaggtaaatttcaaaacacttctttccaaaatcttttatctcaaaacttgcattaaaatgagaaaatatgacatctcttaaaaacagaaaaaaggaaggaagggggaagggagggagggatggaaggagaaagggagggagggaagaaaagaaggaaggaaaggaaaggaaggaaagggaaagagaaaagggagaaagagaaagaaagaaagaatgaaaaaatgaaaagaaagaaaaggaaaaggaagaaaagaaagaaatagaataaaacagaaagaacacaattatttttatgtctggaaagatacagggaactttttcccaaatgaggtaactttgaagctgggagacagattcacacgttcataaagtgaaacttccagggcataatttcctaaattatttctttcactgccctcttggtagctcagtgtcacggatgagtgagtttacctcacaagtaagcatttagctcccccaaaacagtctcttaaccttagctcaccacgtgattagactcagggtgaatgcacaagattaatgagagccctgagtgaaaacagtctcttgtaaggacagcactaaatcttgaaaggctggtggttattgtttgtggaagctgagccctggactaatcccagaagggatcatggtggtggtgactcctaatctgggtatatctttcgggcttgatcatgtttttctgtgactgccattgtgtgtctgttggaatctatttttaggagccactgcatatccttgtgttttcttgctgtgcctaaatgtagatccttctattctacttttactccatttattttccagatgatataaagaggacatattctcacatctggaagttaatgccttggttctagtttattctccctccaagcacactaaagactttttcatttcctagcatcggtcttctagtggccaataaaatggcaagaaaagagttgggaaattcttccctttctcctcagtttccccttattttgttgcttcatttaatcctattctatttcagtaaaggaaacacggtctagttattgcaagggagaaagactagaaaggagaagatattggcaactagcaatcagccaagcaatagcaacaagagattcaatattgtcaggtgaggtagcctggttggagaatgcatatgccaattacaaatcgatcataaacaaatacttatacgcatgcagaaaatcctaatctattccactttgcccagtttctgtccatggactaatagtggtggtctctaaagagcactctattaggcaagaatgaggcattgattttataaaacagaatcttcaaaggagggggaagccaggcctgtggggaaagaaagcagaagtctggcaataggtcatgggaaaggaaggaatcactgtggggtttggacttggagagaaaaagtagcagcaggtcacaggccaacctgtcattagctttaagacacacacacgcgcacacacacacacacacacacacacacacacacacagccactgcttacctcagaatggattgggttaaaggttatttttttcccctctcaagactggtttcctatcttaagtttatgttaataattttactgcttctttacagtcctaagtttgcatatggagaggttaggtctcaaaactttcaatctcatagtccaaggtatgcccttaaagtgtaatgtggaaagggttctctttggctacacatgcatcagttttctatcaaaagttattttatagcagactgctattgggtaattgagatgcactttactaaaaatataacaggtttaaactagtggattttattaatacttgtttttgtttttacagtccaattacctagaacactatggtttattcagaacaggtatcttttgtttttatttcaaaaagtacattgattatttttatgaatgtttaaaatttaacagctttctatgcttttgcagagtgaaaatttcaacaaataattttttatttgctgtgattcttttgtaaccatagatattttttatttaagcgaggctatgtatatagtttaagactttgagaaaatcagtaaacctaatttatttctttgacaatattaaaagagcttagtttctggtattagaaataccatcaagacagggctttattcataaaatattacaagatgcttaaagcagtggcttaaaagaatagatttaacgaagcactattttcattttctataggtctgtaaaatattatccccacaacatagtgacataaaacacaactaattatttgctcatggttctgcattttggacagtatttaccagaatggtggtctctgctctcatggcatttagtggaggcttgggctgacaggcctaaggtggcctttcattcttcagggccattccccacatggcctcctagcatttgtagtcccaagctctttacatggagaatggatcccaagagagcaaaagtagaaagtgccaggcctcttataggctagatctgtttaaaggcttggctcagagtgggcacagtaccacttatattgcattatatgggccaaagcaagtcacagtgccagaccagattcacagcaagggaaagtggacttcacagttttttgggatgaattgttcacatttataaggagggaaggaactgttggctgccatatttggagactctagcccaaccttttaacaaatattttgaatagaaggagaaaccttcttaattatgaaggtagttttgatacatatcacctataaatatgcagtaattttatattcactcctaatcttgtaatatgagtttgtttccttgatttggagctatgacattccacgttactgatctttagtctgacaaaaaagagcttgacttctcattcaagtcaatttccaaatgtttactgttacacacttggcaatcaactgagttatttttgaaaacatccccttcaccagtgtagtgaaaagaatatagaggcaaacagatttaggttcaaataccaatcctgcatcttactgactgtggacatttgggcaagttattttaaatgttggggagtaattttactcatttgtataatgaaaataattatacctacttcatcaggatgctatgaagatgaaataaaataattataggacagtcactggacactatactggagggctcatttttcacagttctttatttttactttatataatgacaacagtgctcagaagtggaagtcatgtagtagtatttttgtttgcctttatggctattatgtgattatatgacttttacaacaaaaaaatctaatgagatattcttcttctattaggttttaataattaaaataggctgggcgcagtggctcatgcctgtaatcccaacattttgggtggctgaggcagacagatcacctgaggtcaggagtttgaggccagccaggccaacctggtgaaaccctgtctctactaaaaatgcaaaaaaatcagctgggcgtgatggcacgtgcccagctactctggaggctgagggaggagaatcacttgaatccagacagtggagtttgcagtgagccaagatatcaccactgcactccagcctgggcaacagagcgagactatatctcaattaaataataataattaaaataatagtaataagaatatgttttatgatttcctagttcagaatattctattattgtatattcaaattgcacattactgatgtgttttgtgtcaaagatatttgtgggttacctaggagaggtatatgaaaatatttttattattaattttaatcttgaggtgtagtacaccaatttttttcttgtcataaaatagcatgcagcaagttgaaccttggctttttctgaagttaattggacagaatttgcagacagcttgcaggattgtgtccaagtagattttaaaatttcagaaaaatgcaaaattatcattaacaaaattattatcgcagacaatttcatccaagtagatatagaaatagttgtaaaatgccagtttgcatctgagatgtatcacaatgacactgttttcatagttgaataagaaataagactattcaacaagtactcatgtcaccatgaaagagaaaaatgcagagctgaaggtggcatgacacattttcccattcacagctgagtgggcaggtgacgcgtgttagggagagagctgctatctgatattccactgatgaagcttgtcaactaaattgtatttggagttttcaaaatatcagagtggatgaagtctttggcatattttaacatttaactaagtcttacacatggctccagaggaggatcttccttcgccagttaatactaaattaccagtgctttggcaggaagcagaaagtgccatgtgggtagtggattctggagagttagcattgaaatactcactgtacattacatttatagaaaagattgagaggaaatttcttcctagcaggcttcgtgcaaggtttgggccctttctagaacgaactgcaagtccctttaacaatatccctgtgatctatgcatataggtgagatcatcatatgtcttagaacaggtttgttttgtccttcagaaattataccccttgtgatcaagtccagcctgccttttgccaagccagaagatattttttaactttgggaggacacaacagaagagagatttgttttcactttggacatgactgagtagttgcaggctctcagtggggaatagactcttcataacattagcacagtgatatacggacacacaattgcggaaatgcagatgcagtgttttcatttgatttttggtatagtgtttcttctgaataaatcaagcataattatgagccacatgtgactaaatcagatagagtaattccagggaattggttgatatatatcaagagctttaggagagaaatgttcgtggtttatgtttattattttttgttcatagcaatctctgaaagcagctgctatgcaagtcatttgtcattcttttccactaagtgccagtttgccaagtgagctttcatgtaagtggcggcgtttatgcaaatgctaatgcagtttttaatcttagaagcaaagaacctgaatattttgctaacatacaataacaatgatacttaatattaaatagcagcttttatccagggatagctatataatttacaattgaattggcgcaaattatttacatacattgagggcattgggttaccatatttagatcatagtttatctgatgtatgaacacactgaaaggaaatgtgaaatttgtattcagcatcttcaaagagtagaaaatgactacctcaggcatctaatagccaaaaagtttagtcacactcatacacaccatcttgaaattgcttttatttaccactctcatccttgtttcaagtctagttttatactttatgaatctgcaaatgattgcctttattgaaaggtttgtgttattcaagatgacttgtaaagtttactcaatcttccctagcaagggaaacaggaaattccagagaacactagactcagcaaacctataaaatctgagaaagcagaccattatttctggagacatttcacataacactttgggaagcaatgactaattagtttttggtcttaacaatagcactttcaggggctgttttctttctttttttttctttttatagctttcatattaggaaaagaagaaagtagctctgaatgatgaaatattggcaatgtatgcacttgcttctctgtaggagctcaactctttgatccttcatacaattaacttcattgcctagctggtattaaccggctggagagtaacaaccaattgttgcaggcacaacaacaccctaatatgctttgcctttaatgactgactgtttcaaattgaaagctctgttctctctattcctaaattcctgttgaagtaagttaagtccttaaataagtataggtactcattcacacctacagccttatcttttttgtggcaccttacccagtccccaattgccagagaatacttggtcattagcaggggtaagatgtattctgggttctctagacgtaaacatttgaatgttaggtctccttgcttgcttttatttctttattttttttttacctccttacttatttagtcattcattcattttagaatttgacttccatatgtctaaacacaagcagcctcccttgactcctcttccctctcccaatccacaatcaatctatctttgaatcctatctgctccacctctaccataatcctgctgatcctggcctccaccatggctcttggattattacagtaaccttctcattgatctccttggttttgtccttaatccccttcccctccacctctcatcgcccaccctggacacagtttctttcttcttctttttttttttttaaatattttcttttattgtggcaagaacacttaagagggtgagacccaccctcttaacagatttttaaatgtataatactgtattgttatctgtaggaataatgttgtacagcagctcttttagaaattattcaccgtgcataactgaaattttatacccattgattagcaactccccatgctctcccctagatcctggaatcactattctgttctttgcttttgtgagtttgactgttttagttacctcatgtaagtggaatcatgcagtatgtgtccttctgtgactagtttatttcacttagcataatgtcctcaagttccattcattttgtcgcatatggcaggacttccatttttttaaggctgaataatattccttttatatgtataccacattttaaaaatgtacattcatctgtcagtgtacatttatattttcaatttttttataaatactctaagtgggattgctggattgtatgatagttttaattttaactttttgaggaacctctaccgtttttcatagcagttgcaccattttgtatttccactaacagtgtgcaacaaactgaaaagcttctacacagcaaaggaaataatcaacagagtgaaaaggcaacctagaaaaatggaagaaaatatttgtaaactaagctaaacatctaataaatggttaatttccaaaattacaatgcaacagtaagaaaattaataatctcatttaaaaatgggctaaaggtttgcagggatatttctccaaagaagacatacacatgaccaacaggtatatgaaaagatgctctatgtcactaatcatcaggggaatgcaagttaaaaccacagtgaaatatcactttatacctgttaggatggctaacctcaaaacaaacaaacaaaaacaaaagagaactgttgacaaggatgtggagacattggagccctggtttatcctaaacccagcagccccagtgagcttttagaagtcataccatgtctcttctctgctcagaaccctccagtagcttcccatctgcctcagagtaaaagcaaaaatgctttccagggcccaccagaatctgtggctcccctcactctgattcatctcctaccactctttcctaccatgctggccttgctgcaccatccacatgctgagcacacaccacattggtgcctttgcatttgctgatcccagtgcttagagagttcatctccagatatctgtgtagctcctcgcctcacgtcttcagatctgtgctcaattgtcaccttctcagagaagtttttcagatcaccctgtagaaaatagcaatcctacccacctccaacctacggcaccctccttttccccttaccctgctttctccacagtccttatcaccaactagcaaggcttgttgttttgttacttgcaatcgatctcccccattagaacatacagttcacagaggcagagaatttgttttggaactgctgtattcctagcgcctagaccaaatgtctaccatgatatgaattaggagttcaacaaatccctacttcatactagttgaatgaaaaaattaaataataagtgagtaggaattaatgcctctactttcttctcatgttctttcttttatcttaccctccccactgccacctttctacattgtgccaagttctcatgtctcaagaatgtggtgttttgttccttgttagctgtaaatgtaatactccttcacccatttttatagaaaagttaactttcccctggatgcttgggcttcatcatttaatgtcctcaattgcagatggctatccataagtttgactctgtgtgtgtgtatttgtgtgtgtgtgtgtctgtgtgtgtgtgtgtgtatgtattttaaacttgtctttaccttttagtgtttgcagtaaaaacaaaggagattatagattacgtgtttttggtaaaattttttcatgttgttgcaagtcattcaagaatgaatgcaaagcataaagtttaaacttggagaggcagaaattcaaaatttctttgaaacgaatcatcgaattcctatgctatttagatacacttccattgagtagagagctgacaaagaatacacatttttctcagtggactgaattcttctttaaattaatttgtcagtatttgattgaaatactaaagcaattcatttcagttacattcaaccagcattgcctaagggactacaatgtaaactaatgttaataatttataaataccacttgggtgtcaagaactcttacaggcatttcatacattaggtatttaatatttgaaatttataatagttctataagataaagaatatcatccttttttgatattaggactttgaggcttccaagaggttagtttgccaaaatatacaaagtacgcaaagccaggaatgccaaagcttggaaattgacccaatttgaatttatagcttgaacttgttctcctagactagtgtttttcaaactgtggaccacaacctacagtaattgaatgattttttttggcgatggtgtcttgctctattgcccaggctggagtgcattagcaaaattatagctcactacagcctcaaactcctgggccgaagtgatcctcccacctcagtctcctgagtagatgggaccacaagtacgtgctacaacacctggctaattttttaattttttgtagagatagagtcttgctatattgtccaggctggtgtcaaactcctggcttcaagtgattttccatccttggcctcccaaagtgctaggattataggtgtgagtcattgttcctcacctcaaattctaaattataattatctacacacatacaaataattgaagcgaaagtttcattaagtaaaaccctcaccaggctgggcatggtggttcatacctgtaatccctgcactttgtgaggccaagatgggtagattgcttgtggccagtagttggagaccagcctggccaacatggctaaaccctgtctttactaaaatacaaaaaaaaaaaatagtcagatgtggcagcacatgcctgtaatcccagctacttgggaagctgaggcatgagaatcacttaaacccgggaggtggaggttgcggtgagctgagattgtgccagtgccctccatcctggacaacagagtgagactatctaaacaaaccaaaccaaaccaaacaaaacaaaactaaaccttaccctatgtaacacactgatattttctattctgttccagactaatctcatctagcctacacttgccatgccttgcattgcttatcctatcttgtcctgtcctgtcctgtcctgtcctgtcctgtcctgtcctgtcctgtccagtccagtcctgtcccattcctactcagcccatcccatctcagaacccactaaattggccttgtgatgcacctactgttccatacagtttctatatgcttgaaacactgtggatacaaaataggaaaaaattaaatagtaaggaacttacagataaatgaaaattaatcgttagatatggtaatgatgcgaaataatatattaaatgttaaagccctttgactcttttacttctatcagggcctgaaaataggagatattccttgaatcactcctctcagatactttcaagggtcccggcctgatgaagtcatgagaactagggaaacgactgccataatgtagtcacatcatgcctgtgtaacttttccatttattttttcttcgtccgtgacatgaattttgataccaaccaaaatctgttatactttaattttacaggggtttaatgcatgtgtattatttccccaacaaccctgaggacttcaattcaaggaatagccaaataagatagctgtaaatgagagggctcccaggcaatacatcattcctgatgcaaatatcattgctactaacattattattatcctattatacccccatgatgccttaaaaagtaaatattagataaatacatactggattgatgaatgagggacttatatgctactttcaataaatacgtaaaatacgattgtgggtatgactgtgaatttcatatcaattccttcagactcaaacattaatttttttgtctattgtaagaaaaatcacgaagtcagtttattcagcatttattgagaacttggtatctgtagaaagaacactgtgttgagtactattttcattgcctacatgagaaagtcagaattccagaatgtgtcctttttacctcttcaaacgcatcttctgcaccttcctcctcacatccttctgggcaagtactggttgaagtgtcctgaataaaacaggtatccatgcctttgtgccttagcccagctgtttagccctatttgtctgacaaattcaatcatggctttcaaaatctctatcaatcaaatgttgctttcttcctccaagttaagagttgcacctccatccacctatccatctatccactcaacaaatgcttattaagtacctactacgctccagctctgaactgattgggaagctctgaactatctgccattgggaagcatttctttttagctctgggtacccactggcagctctcccattccatccattacctgtctgtttcttctaatagattgtgaactcttatgaggacatgtattttaacatatttacctttggatttttagagcctagtatgagggtcttgcacatggtagacagtcaacaaatgttgaattaatgaatggagaaacattaaataaaaatggacatagatttctcatcacattcctcatgattgtagctattcctattccttcagattctgggcctttgttaaagcattctcatgcactgatatttgcatcttcccctataattgggaatagtgctactgtctacctactgaacactgttgaaaatttgaatgttcattttgcatgcttgaaataccagtggaaggccgggcgctgtggctcacgcctgtaatcccgtcactttgggaggccgaggtgggcggatcacgaggtcaggagatagagaccatcctggctaacatggtgaaaccccgtctctactaaacaaaaatacaaaaaattagctgggcatggtggcaggtgcctgtagtcccagctactcgggaggctgaggcaggagaatggcatgaacccgggaggcggagcttgcagtgagccgagatcgcgccactgcattccagcctgggcaacagaatgagactctgtcttaaaaaaaaaaaaaaagaaaagaaataccagtggaagggttctgcacaggaggatcatagtctatgattatacacacatcaaaaagctaatccaccctgaccaagtaggctttatccctgggatgcgaggttgctttaatatgctcaaatcaataaaaatgattcatcacataaacataactaaaaacaaaagccacatgatcatctcaatagatgcaaaaaaggctcttgataaaattcaacattctttcatattaaaatccctcaacaaactaggcattgaaggaacatacctcaaataacaagagcatctgtgacaaacccatagccaacaacatactgaacaggcaaaagctgaaagcattacccttaagaaccaagccaagacagggatgcccactttcaccactcctatttgacatactactggaagtcctagccaaagcagtcaggcaagagaaggaaataaaaggcatccaaataggaagagaggaagtcaaactatctctgtttgtagacaatatgattctatagtctctgcccaaaagctatagtctctgctcaaaagctatagtctctgcccaaaagctcctagatctgataaacaacttcagcaaagtttcaggacacaaaatcaatgtgcaaaaatcagtagcacttctgtacaccaacaacatccaagctgagaaccaaatcaagatctcagtcccattcacaatagacacacacacacacctccccaccccaggaatacaactaaccagggaggtggaagatctctacaatgagaattgtcaaacactgctgaaagaagtcagagacagcacaaacaaatggaaaagcattccatgctcattgacaggaaaaatcagtattgttaaaatgtccatatggcacaaagcaatttacagatttaatgctattcctgtcaaactaccaacctttttcacaaaattggggaaaaaaaatcctaaaaatcacatggaaccaaaaaagagcctgagtagccaaggcaatcctaagcaaaaagaactaagctgaaagcatcattacctgctttaaactatgtgacaggctgcagtatccaaaacagcatggtactggtacaaaaacagacacatagaccaacagaacagaatagagaacccagaaataaagctacacacctacaaccaactgatctttggcaaagttgacaaaaacaagcaaaggggagatgattcctatataatatatggcactggaggaactagctatccgtatgcagaagattgaaactcgaccccttcctttcaccgtatacgaaaatcaaatcaagatggattaaagacttaagtgtaaaacctgaaccctagaagaaaacctaggaaataccattctgggcataggccctggcaaagacttcatgacagagatgtcgaaagcaattgcaacaaaaacaaacattgacaaatgggacctaattaaactaaagagcttctgcatagcaaaagacagtatcgacagaataaacagacatgggagaaaatatttgcaaactatgcatgcaacaaaggtctaatatccagaatctataaggaatttaatcaaattaacaggcaaaaaacaactctattaggaagtgggtaaaggacatgaacagacacttctcaaaagaacacaaacccatgaccaacaagcatatgaaaaaatgctcaacatcactaatcattagagaaatgaaaatcaaaactacaagagataccacctcacagccatcagaatgcttattattaaaaagtcaaaaaataacaaatgctgatgagactgtggagaaaaaggaacacttatacacagttggtgggaatgtaaattagtccagccattgtcaaaagcagtttggtgattactcaaataacttctaacagaactaccattcaacccatcaatctcattatcgggtatattcccaaaggaatataaatatttccaccataaagacacatgaacttgtatgtttgtcacagaactattgagaataacaaagatgtgtaatcaacctatatgtccattgacagtagacaggaaaaagaaaatattgtatctataccccatgaaatactacacagccaaaaaaaaaaaaaaaaaaaaaagaacaagatcatgtcttttgctgcgacatggatggagctagaggccattatcctaagtgaactaatgcaggaacagaaaaccaagtactgcatattcttacttatacttgggagctaaacatagaccatataggaacacaaagagaagaacaatagacagtggggcctacgtgagggtgaaggtaagtgggagagtgaggattgaaaaactacctatcaggtgctatgctcatcacctgggtgatgaaatcatctgtacaccaaacccccaagacatgcaatttacctatgtaacaaacctgcacatgtaccccggaactgaaaagtatgaaaaagaaaaagtctatggctatatagactatggtaactagggtcaattaagtaatatttgtactatactagtagcaaaactttcgagagagagaaggtattggaaaactttgctactagtatagtgcaaatattattcatttgaccctagttaccatagtctacatagccattgactttttgttttttacaattttatgttcgggggtacatgtgcaggtttgttatgtaggtaaattgcatgtcttgggggtttggtgtacagattatttagaatcaacttattgtgaaatatttatgcatttgtgcaagctcattcatacagacttcttattttcaatcacaaaacaattggagaaagattaaactagaatatatctatactttagaatggaatagaaacatatgtctagacatggaaagatgtccaagacatgttgctaagtgaaaagagagtgatatgcaatatatatatgtgtatatatataataaaatatataatatataaagagagagagaaagaactggaaaatttatatatatataaagtatacatatatatgaaatatatgtgtgtattttttattgaagaggcgaggtttcactatgttgcccaggctggtctggaactcctgagctcaggcaatccacctgccttggcctcccaaagtactgggattacaggcgtgaacaactgcacttggccgattttccaatactaatattgatgactcctgtgtattttcttttaatatgtatgtacacaacatacatgaagtagttttacaaaaattgattactgctgaaatcttaagtggtattgtctaaagtttgattaagatgatatttttaaaatttctacttcaaataaaattatgcaaattttattattgctaccccacaaaggtttaggcagtaatcttaacggaaaaagcctgcagtctttgaaagttggtgtaatcgtattaggaattcttgtgagtaatggtaaggtaaatgggaaaagatttcccaatttcattcagttttcatttaaaaaatccatatgtggttttgttttcatgctaatttctgatagactgatctttatgaatccatctgtcttaatgattttaagttgtggaattgtcatgagggactgtttggtgcttcacatatacaataaacatttaatttaacgtctttgcacgggaaagtgtgtaaaacatttagcatctgctatgaatggttataccttgtaaattgtaaattcaatagatggtgttttcataaaaatttgcatgtgctaagtgaggcttcattttaatacacaatttatagttaaatcatctctgtgttagcagtaggcagataatgaaatgtagatggtggttcagcattgtttatttattgagggaagaagtagatgaataaggaatagatttgatgtgatgaaaataatgggattgctggtcctgaaattcaagcctggttatatattatttactgattaataaatctaacagatagcatgaatacacatattattaagtaaagattctctttaggatgaaggtcatgtaaagccagagatattttgaagactgtcttcccatgggactgggagttttatatactaattaaaactctgtaaatttcctcacagcactagcagtccagtatcaggttttctgagctgattttaattaaagttgattttaggctcaatttaacttcatttgaagctaaaatggtctgcagaaagtagcctttaaggtctgagggtagaaggagaattgtgaaagagtgtatgtgtatgtgtgcatgtggtatgtgtgtgtgtttatatacatatgatatattcaagaacactaaagcctgccaaaaatatcatatggcttttttgttactgtagtttgtttgagctctagccagaggaacttcagccaaccaaagtcagacccctgaatcaccagtgtgtatctctgcgaccatggacaactcatttcaagcctttgcatctttatgtgctcatctatactctgtttttaaataattgctcccatcaaaatatacacttcagaagtcataagggaaaaagattgcaaatttaatatgttgtaacttccagataatgtgtatatatatatataatctggaaattatatatatataatctgaaagtttatatatatatataaactttatataaagtatgatatgaaatcataccacagtacacgcacacattgtttggtactatgcagtgttcgaaaataattttcacttctctgatgcccttaactgttagcatcatcactgtaatgcaggcaaagataatttataatttctgttggttttaaaaatattattaaaagtttagtcccaaaaatgaaaataattcatacatttatagaataaaaagggaaagtccctctcacaggattatagaattaaaaattattaacacttttctgtatctctttccagatccctttttctgaacatttacacacatgcaccacacacacacactgccacattatataacgttacacacacacacacacacagacacacacacacatacgtagcatatcactgtcttttcacttggcaacatgtcttggacatctttataacatgtatatacactttatataaagtggtatatatataaagtttatatatataataaatttattagttggctaaatatttatatattaaaaataaatagtatataagttctcacaaatcaaactgaatataaacatgaacaaaggatatgcaaacacaattcatagaagaagaaatcagatggccaataaacatatgacatatgcttaagttaataaattatcaagaaaaagttaatatgagatacctttattcactctgaggattgataaaaaatctaaaaagattcctgttatccagtgttggtaatgctatggggtgtgctgggcactctgatatactattagaaaagtttgagggaccatgttttcatttaacaatttaaatataacactttgccagtcattggactttttagaatcaatgtattgtagtgaaatatttatacatttcttcagactcatgcatgtagagtttttattttcaatcacaacacaattggagaaagattaaactagaatatatctatactttagaatagaaacatatgtctagacatggaaagatgtccaagacatgttgctaagtgaaaagacagtgatatgctgtgtgtgcgtgtgtgtgtgtgtgtgtgtgtgtgtgtgtaacattatataatgtgtctgtgtgtgtgtgtggtgcatgtgtgtaaatgttcagaaaaagggatctggaaagatatacagaaaagtgttaataattgttaattctataatcctgtgagagggactttccctttttattctataaatgtatgaattattttcattttatgggactaaacttttaataatatttttaaaaccaacagaaattataaattatctttgcctgcattacagtgatgatgctaacagttaagggcatcagagaagtgaaaattattttcgaacactgcatagtacaaaacaatgtgtgtgcatactgtggatatgacatcatccttagtatttgtacttccatataatgtatattagatgtaactttggatgagtgtgagtaccctccacttaagcagttaatttatcttacattatctttatttatcagatctggtggctttgaataatgctaaatttcgcttctgatcatcccagagaatcaaaatgaaaaggttgccacatgtaggagttttcagtctgtttcattctctctctctttctctgtgactacaaagtgtttccctattctgcttttttcttcatctcttttctcattgtctctaattctaaaaacggttttctataaatactggaagcgcattgtaatttgacttcccaatagcaatgataaactttgaaatgcttaatattgtttaaatcaagacaacaaatgaaaccctgtctggctatcagtcttgttacagtctctcacttaggtaaagactcaagaacttttgcccatctcacgtctgcttcatcaggttcccaacatcctgtgcaccgataatgctaatatgcccaccatcaccttccccgattcattactcgaaggaaccctgggaaatttttggctcaaaaacttcagaggtcctaggtctcattactactgtcttcttattgacatggagacctatttgtagtttgagaaatcaatttagtggtttgaaactggcattttaaacacaagattgaaagtatcagaatgtataatatgtagaaagagtaagagaagtatcatttcataaaactttaatctctttctcgctcttcatacatacacacacaaaacacattcaaatctctctctctctctgaatgtacatacacacacacaaacacacaaaatgtaaaatgtatttctattatgggttgtggtaaaaaaattcaaatcttctattttttgaactgctttcacttaatgatagtagatattacttcacttaatgatagcaataccttcaacttgtattgatgcttgataaaatattttatgaaattcatcattgtacccactcttaatacattatcaaggaagttattcattacatcacttcatcatggagactgtaagagaaattcctgtatggtataaatataagaataactggacattgttttgttttgtctttgggatactgtgaaatattctcttaactaggtttacctcttttttttttcttttttttttttttggcggagtttcactcttgttgcccaggctggagtgcagtggtgcgatctcggctcaccgcaaactccgcctcccaggttaaagttattctcctgcctcagcctcccgagtacctgggattacaggcatgcgccaccatgcctggctaatttttgtatttttagtagaggcggggtttctccatgttggtcaggctggtctcgaacccctgaccacaagtgctctgcccacctcggcctcccaaagtgctgggattacaggcatgagccaccaggcccggccggtttacttctttatattgtaattaaatagactagaactaatgctgtgattcccccataagtgaataagggtttttgtatgcattttactttgtcttatttcagacatttttaatctctgttcttgtttcccttttctatttctgatattattttataaacctactcttgttttctatttcattacccttatcgattatattaactctttcttctaaaataaataacattttctgaagaaaaaagacatatacagatgctgatgattctaagatgccataatcactttgtttgccataataaacaaacacaacaagacatgtaaaactcaggaatttctctttcttagtgcagcctcatatatgtcttcaaaccttgatgatcttttatatttaaatactatcttttctgaaagctgcttgacttccagtctttcatattaatgttttgtaagccaagagttaatgatattaactgctttaattaagtgcattagggacacgagatttggcttctagttccagatttatcactgtgtgctcttggagaatttggcaattcaatggacttctctggatcatgttccttcatctataaaatggatatgataatatcaaattctcataaaagctgaagggataccccagatactcaaagttctttcttaggtctaacatttgtatatcaaagaacatgtcattctgttcgtttgttaatagcaacttcataagctcttttatatccagtgctgtgtagacatctgaccttttttaaagaaaaaaaagtattccattgcttcacccacatcacatgtcagcttttattgtaatattttactggaacatttatctttctctttatttttggattaccttttatcttttttgaatttttagtatcttagcacttgcatgacaatgaaaaatgttaaatgtttaaataaatatatttagaagtattaggtgcatataaaatacacacatataagcacatttaaaatctccatatttttctatatagtggtacaacacttgcttggaaataacatgaagtgatttatctcagctcttattttcacacatgcataatatagattgcaaattgtgttacattctgaggacattcttcagtattcacttgtttggaggtgagactctcaggagacttatgttttagaaatataaaacaaaagaaagaaaattatttaagaatccctctcttcttccacctatcttccatccagaaagggacatatatatatacacacacacatatatgttttgttgttgttgttgttgttgttgagacggagtctcactctgtcgctcaggctggagtgcatggcgccatcacagctcactgcaagctccgcctcccgggttcacgccattctcctgcctcagcctcccgagtagctgggactacgggcgcccgctaccacgcccggctaacttttttttgtatttttagtagagacagggtttcactgtatttgccaggatggtctcgatctcctgacctcgtgatctgcccgcctcagcctcccaaagtgctaggattacagacgtgagcccctgtgcccggctgggacttacatatttagaagagatacagtgacatagaggggaaattagttttcacagattttcaattcccaatgcagggattcttcaaagtcagagcaacctacagatgatagatgactaccaatgacaatgttttgacatcatatttacaggatttctttccggtcaacattgagcattttctacccctatgtataagagtggttgggaagacttctaattttttttcctgtccattcatctctcttacaagatacattattttgttgtagccttaagattcatattaatgcttggaaataaatttgagacaatagaagtgaccaaatatttatttccccaccagttgccggactcacattccttcaaagctgagacttccactccatgctatcatggtacatctccctctccacctttccccaatctttgcttaatgtattcatatgctcattttatctccattagggaggcccaaaatcagtcggatatcttagcctgcattggatcctccattgtctgaaatactgtactacagttgtcctcagagttatctgaactgacctatgtctgtattaaattttatctttttgagtgaaaggagtttatactgtcttactactttacaatatctatttgtaattctttagactctagtgtcatggaaaagctgtattttttcttctctctgaggttttcagtggttggatagtcaagatagcgcctggttaattagcagctggtttgtctacctccccagaggaatattcagtcctagcccaaccacaaaagcacagcttcaaacagggaaggtgactttgttgtgagtctaataagatcacaaggggctatatttggggcttcaactacagtggatggcctaggcatccaggctgatagctgattgactcctaataatctgaattattctctcaaaacaacacaactcaatgggagctactgatttgctagggtatcataaacagaaagagaattaatagtagtctctgccctgatacaaatccacttccactgaattgaaacaaactcagtaatcataaactagccaggaatggtgaagacctactttgacctaaattggcttattgacttgagtttttttttctgaagaaaatacctcttattgcttatgattataaatttccacagggattagataaattatattttatcattaattttgtgtacgtggcaacatgattggggaaaattatctagtgattaaatgtaactgtatttgctttgctagaaaattacaccaaagaagaccaatgggtaagtagtctcacctctcttgtaaataccagattggaaactgggtgtgttctaggaagaacacacatgcacctcataaaagtaaatagaattaaatcaacaagaagtaagcactaattataccatagggtgaatagtttttaaaaagtcttgtcttttcaattgttagttatggtccattctaaaaaacatgttatgctcttataacagtgaggagatcctcaggggatgaatattagtaaaccctcaagacatcttatatatgaatatttggtttaaaactaaatatttaactctttgtgttaaatagcagagtaccacccttcatttgtaaaatagaattcaagatcataaatatgtgttggatgacagtagaacccgttttaatttgtacacacacaaacattatgttctttctctccctctctgtgtgtgtgtgtatatatatacatatatatatacacatttgtataaacatttgtatatacatttgtataaacatatatacatttgtataacatttgtatatacatttgtataaacatacatttgtattatatatatgtatatatatgtatgtatgtatgtatatatgtatgtatgcatgtaagcatatatgtgtgtatgtatgtatctgtctatctgaaggagaaaagtttcatgctggccactactaacaaaggtgatttgcaactgggcatggtggctcatgcctgtgatcccagaactttgggtggccaaggtgggttgatcacctgcggtcaggagttcaagactagcctgacaaatatggtgaaaccccttctctactaaaaatacaaaaattagccaagcgtggtggcgtgtgtctgtagtcccagctacttgggagcctgagataggagaattgcttgaacctgggagaaggaggttgcagtaagccatgatcatgccaatgctgcactacagcctaggtgacagagtgagaccctgtctgaaaaaaaaaaaaaaaaaaaaaaaaaagagtgatgtgctatcaacatcaataatgaagtacatgtctcaatagacatctcagtttgtattttctacacactcagttacatatcttgtaaataaaaggggaaaggtagattagtattttttatcccccgaccactgtatatcccatactcatcttagtacttaaatggctatttccaaatacattcattttcttaagcatatgggatgagttgatggtatcctagatacaaaggagtctcattattttattttgccagaacttttttcttccccacaggtttatagtttcatagttctttatagtatgctacgcccaaaggaggcatgaataccgaaataaaaaagtgccaatgttaagatacatgttttgcaccagaatataaattttcgcattggttgactgataacactgttgtattgtcatttttctcaaagtaaggtcttactaagcctgttcttgaccattaccatcaagtaccattaccatcaagctatttataatctttgtatttagtttctatgtactagcaatagaaaatattatctttctcatctctttcatttagtgactaaatttccctagaatatacaagtgatctaagacccagggctggaaatgggaggtacatgtgagtttctcaaattatgcaagagctttatcatactatggcctgaaaaattcctgcatagtggccattgtctgtcttatagaaaggcaggagtttgcattcaccaaataaacgaaacaagaattcacagctgcagaaaattgaattacacattttcttaagacaatagtcatatcatggcaacagattacctacttaatcaactgtaatcaacttttagtaattgtgaaggtaaagttagttctattagctcaactcaaaacttcctttaagtagtaaaataaatctaattacattgagttaacttttttgatgactatagttttctactataggctatttttcaatgagttgaataatttgcttatatatttatatttttttatgatagtgttaatcaacttgacatatcaagaggataataattttctgctcattaaataatatccctaactatattgtcaaagtactcaaaatttaatgctgaaatatgtaggggctgagcggcctctgtgattgtttcagattgcatcttccattgttgaaagaattacctgtgatatcaattaatgttcatagaattttcggagccaattttaatgaaaagttaaacccagtactgtttatcagtgccagtaattgctctcctgtatgttataaccaggcctatctattcccaaatgccccgaggcagagctgtttatagatagccatgaaaacaatgttttgaaacttcagcttgcctgaatcaaaaacctccttttatgcatggttagttaaatcagccaaaaagatagttgacagcaatatttgaaaatatcctgaaaatggtttgaccttttcattaggtgctagaaataaaagcagagaattaaaagaagacttctatttaaccttttgaacaaaaaccggtttacaagtcaaacatatcttaggattgtgcgtgagctgctgatgacatagacactcatttgctccttaaagaacaaaatttgagcacaaggaaagaaaacctttctctggaacaagtaagctctatttaaaaagtgtaggtctctatttaaagagagtagggctggcaaaggcctttgtcgtctggccagcaaagaggataatgtgcagagacatttaaattcagtgggacaaacactaccctttgttggctcccacactctcagacacacacacagaacttccactaaagtgagagaactgtatctaatttggaattcagaagatggccaaaaataaatagtttattgtcatattcagatattatattcatggttttctaggttggtgtgtatgacatcactgctttaaacccagccatgcatcagcattggtcactgttctttctcatgcctagtcggggggtgggtttaaaagaagaaagtgttgagcatagatttgacaggacttgaaaactgggaaaggtttagggatacacttttgagttgaatcttttcctttttgctaatgctgcttctcatataacgtatattcaaatatattaggttttttaattacaaaagtaatacttgcttattgttttcaaatatattatgggtaagctgttttttaaaaagtgaaactgtctttctgcctctatgtccacatcctcagcaaaagcactgttgatatagtttttttcaacctttttgctatgcatttacaaatatacacgttcttttgtgtgtgcgtagatgtagaacatatattccaagtgtcattgagaacaacatatattttcctgcaagatgcattttttgaaaaaaacttggaaatatcaagggctgccttctgtgttaaaagctataaatactttcaacagattatccacagttgtacattatccacaatgtaagtgtaacatgattaatttttttcctaaggttggatatttagtttctctaaaatttttcactactatgaaaaaaagattcaacgtatatctaagtatatgctaatcaataaatgcttgtgaccatgtgagctttacattaaaaacaaaaagttttgaatatttgggtaaatgttgaattcccatcttgatagattctttcaaccctaaaaataagataggattactgacgtctttaaaataatggaaatatttattggccctagtgtatctgtggtatcattgaccttttaaaaaatccaaatctagatatgagtcagtggtgtgaaaacaaaaaataacagagagtttaaaattatttatgatgaaatatactgacacctaaaataacccccatgtgaagaaatatttcacactttattttaatatattttttatattttacagaaacacttatatatcgcttaccacaattatggtcactaatattaacctttttcatttaccatttttttacttcagagataaaaataaaaccaataaagttatgctgcttataaaacagaagaccttgagatgtgtctagttttattatattgttgtggagccatttgtattgttagcccatgtagaggaaaaacagaaatgcagccacgtccataattccttttattcatgtgtaggttataatttgaaatacatcagattaatgatcttagtcatgcaaatttaatttataaagttgagattattttcaccaatacctaaaacatctgtattcagagtttttgttaactatgctttattatccaggctgaatattgtagcaagaactttatagttaactgtcatatacatctcagaagactggcatacattttgtgaaatctatgaatttgattgcttaaaaactcctttggctcctatagtgtatgtattcctattagaatatacaattgaaagaacacaactagagcgtatacaaaggggagtggttaaatcatagaggaccctgtcacccacgctgtagtggagtggcatgatctctgctcactgcagttctgcctcctgggttcaagcaattctcctgccttagcttccctaatagctgggattacagacgtgcaccacaatacctggctaatttttgtatttgtagtagagaggaggtttcaccaagtgggccaggctggtctccaactccaactccaactccaaatccaattccaggcctcaagtgatccacccacctcagcctcctaaagtgctgagattacgcgcgtgagccaccatgcctggcgatctggaggtattctcctgtgaaaaagagacaactgtgattgttataaattattccataaactcttatgtgggaaacacattaaatttattctgtatagctacatgaagccaactaagaccaaagagtagatgttgaaaggagagcaacgttcaattttagtttaatccttaagaatatgttctgcttatattaataacaataatgcatatttatcgtacaaaatgcaagaaagcattaaaagaaaaaatatcacctttgatcccataaccaagaaatggtttggtaccttttctttaaagattttatatatgtatggttgtattcaaattgagtattaattattagatttctaacagttattaaattgcatagggaagagagggtaacgtaactattttatggtaaattgaacatttgtaataatttttttatttaaatattccacttttgaaaatggacccattccatcagtttcctttttggtcaatttcctattcatttctgaaaacaatttggaagagactcctttcaaaaatatattgcaaaaatggtacaaattaatttgcaaagtcaaattgtgtttttttggaaaggattcaggattttattgctaaaagtgagttggaaaacaacttggactgcaaggctcctgaaattctggtagaatttgatgtgttgatagttcaagaagaccaaacctacaagatttgtggcatagtagatgcttaaaaatataataataaagtgacagaatcggggcagatagaataatttgcatgtcagaggaataagaaaagctcttgggccaattaataggccctagagtattttgtcaaaactgaagcctgtgatataaaatcttacctttttgtgctggcaaaattaagcccaaaacactttataataagtaagtctgaacgtatgtataccttaagaccctgcatacacctttagatacatatccaatagaaatgtttacactaaatgtgttttccaaaagtacatgcacaagaatgtttgtagcagccctatttatagtagccaaaaagtgagagcaatgtgcctcaaaattagagtggataaattatgaaacattcatgtaatggaacaccatacagcaatgaaaaagaatgagccattgttacatacaataatattggtttaccttacaaatataatactgaaagaaagtaaccaaacacaagagtgcctactatatgactcaatttttataaagttaaaaatatggtcaaaactaacatggggtgttaaaagtctggctagtagttactttgagggtattaatgagagagggcacaaggagtgctgttgtggtgttcaaatgttttctttcttgatctagctggtttattgggagtgtttacttatattaatacactaagatatacacctatggtttgcccgcttttcaggatgtatgtagcactggaataaaagtttacataaaataaaaaagtttccccaccatggctcttccacccttcacaaaaaatactttctccattaaagaaggagctcagagttataaatattactgaaaattttattaaagatacatttaaatatactttttaaatgttttgtttaattttgaggaaaggtcttcctcaagtttattataaaatttaagtttactaattatctgtttgcagtatctcagataatgaaaatctccaatttatacctctgctctatactcatgtcttttctatttaacaaaattagaatcagacttttaaaatatgtttcacctattattctgtttttgccatttttcatgacattaaatatttccaactgaaatacgttctaacaaaggtgttaacaaatgaaacaagtatctcaaaagatcatgctacctctattaaatatttgagttgaggctgcatggccacttatgggagaagtaagtggactcagactaagatatcaatgcctggcaaatattgggctgttcaatgtgtctgtggaatgaattaatgtttttggaagtccttccaactctgattgcctagaataagcaaagtcagcaagattattgtgaaatgctcactcactgacactaaatggtacataacagtgcctggttctaattattacatcaacatctgtgattactgattcaaccctagctctttgatatttattcaccaactttgccattgttttaaagatagatgataagcaccatgaatactgatggaagcctttgcttttggcaaagggtagacaaggtgtctccaaaaaggctttatttcagcggcagaagaatttctaacagagcttgtaaacttatttttagtctccgcccctttcccagttctggttacagggcagacacttttagtaattttgcttgtctgataaatgattctatcattattgatattgttcttctcttagccacatgtgaacacatttgattgagactttaagaaataaattatttcctatttcaagagtgcttctcttttgttacagaactcagaggtctgacttggaattgtgctttcattgtttcttcatattcatactataactaatattgctaatgccaaactttttattctattttttaggaagaggtgaagcttcagagattatattgtgattggtcagcttcttaatcagaaggaaaggagtgtttgtttagatatctcatacatttactttttgactgctatgcaacaagacatagaaaatgagggtgaaagtgtcaaagggaaaagagtagtagatgtcaaatgtcatacgtgtttctacatggatatatgttcacatataggttatgtatacatatacataccgctgtggtctgaaagtttgtgcccctccaaaatttatgttggaacctagtcaccattgtggtggtattaagaggtaaggtctttggaaagtgattaggtcagaatggccttgccctcaagaatggattagtgcctttacgaaacaggcctgagggagcttgtgggcccctttgccctttcatcatgtgacggcacagagaaagcatcgtccatgaggaatgggccctcaccagacataaatatgctagcccctcgattctggacttcccagcccccagaactgtgagaagtaagtttctgttgtttataaattacccagtctaagatatttttgttatagcaggctgaatggaccaagacacatgtatatgtgcgtgtgtgtgtgtgtgtgtgtgtgtgtgtgtgtgtatatatgtgtgtgtgtgtgtatatatatgtgtgtgtgtgtgtgtgtatatgtatatatatatgcatacatataggtgagtatattggattacattagatagatatgcataaataatggagaatctcgattggccaggagtagaaattatacagtacagatctgacatgtggatttcccagatataatgcatccactgatgcattgtatccactgatttatgtggatatagaggtatccactgatttatgtggatattatttgtatccactgatctatgtggatatagaggtgcttcggcgggggttgggtggggggaaacatttgctattcagccctatcggcatatttggtgaactgtgtgatgtgagatggcttggagaacaggcggcacattttaggaaggagtttgtggtccctaggaaaagcttcactcaaagaaaagagtctggctcagtgacctggaattaaagggcacctggacactaggggaattatggctttgggaacagcatggcaatgtcacctaaatctgccccagttcagccatcgttatggtagatccatatcccagatgttaaggactgtgtggaacctaaaacagatacttcactaaagtattaggtctcaagtaactttgctgtaggatccatctgaagtccggagtcagcatttgaacttcagttagcagccttgagatgctagccagggcagtttgagtggccattgggcagattatcaagatagaattccaaggtcaacagcaaagtgacctgaatcctaggctgaactgtggtagccacacactccctgagcctcatgtagtgatctttcaagaccaggaacaaccaaaatgagcactaagaatgtggcccaaggataacatagaagtggcagcaggaacattgtccaggatacgtcagtaagaacacatacgcgtatgacactctgaggaaacaagcagaaatatcagaagtgagccttggaagttgaggctcatgtcttccaattgagggtcacaacctggagtgtgggcttgatttgtcaaaggacctttgtgggaaactacaggtgggaagacctgccatttgcatagagaaagagaaagaacatgtgaacagtcttataagatgcagacttagatgcatcaatatataattgatatggtttggctgtgtcctcacccaaatcttacctataattgtagctcccataatccccatatgtcatgggatggactcagtgggaggtaattgaatcatggggacaggtttttcccatgctgttctcattatagtgaataagtcttacaagatctgatggttttatacagggcagttcccctgcacatgctctcttgcctgccgccatgtaagatgtgccttttctcttccttcacgtgtcactgtgattgtgaggcctccccatccatgtggaactgtgactcctttaaacctcctttcctttataaattacccagtttcgggtatatctttattagaaacattagaacagactaatacaataatataaacttggacacacataatataaactaggatgctctatcaaggaaacaataaaatgttacctttttttcccaatgtaagtttaccatgattttgcttttttcttattcctgtgatgctttttataaaataaattataaagtattcattgaatgaatttatatcttctaatcagaattttccttaggaacttctctaattgtgtagttagggtaaaaattgctttgtatatgcctgtggtttcaaaagactggaatgtgctatttatctttttatttactgaaggttttcacttacttcttatgtatttcttatactgtattaattctaaagtattaacctatttccaggtgtaatgatgataagtacacaaaggtcagcattgattaaaaaaagtggggggaaggaatttaattctggagctaaaatccatttagttaaacagatcaaggacatacattaataggctgctgcaagcacataatagcctaagacataaataggcaaatatttttttccttggatgttaaattcacagtattcacagtagctgcctagagtattatgttaagaaagaggctgaggtttgtcggaaaagaattagtagtgcttatctgggagtgcctaaactagtgcctgggaggttgtggtgacacaagtgccacatatttgctaatccttgtctaaagcttcccttaactatttagtttagctagttcattaatactatataatatcataacttattttgttttgtttttcataatttgtctacagagattacattattttccaaaatttttgtatagattattacaaataagtaaatgtcagatattttatgcaggtatctggaactaaattatcaatatttataaatatgatctaaatcaaacagtacacttgctaaagcaatctacagatgaaaaccagagtctcatttagaattgcccaaagacaaaagggaagggactcaggagccttgaataaatggggaaattgttccttttcaattcagttgcagaaatatttatttagcaagtaccaagatattctcggaattagattatgcactgagagcctcataatctaatgcgaaaacagacatattattccaaagtataattgcctaaattaataattatagaattgctaaaattttctgaagtgttaattatggaattactaaaagccagcttagatgtaacaaaaaagatctaggaattgtccgatacatttattaatcttatcaaaatactggagatttacaaaatcagagatttttttacttttgggctcaaaaaattgaagttcttcttggacagtgtaattaatcttataattttaggtaggtcactcgaattttgagattaaaactctagaatactttataatagcagtgttttatatttgaatagcactttaaaatttgcaaagtgttatgttttcagatactttacttggtaatataaataggtcaagtactgtcttcacttcctatgtaaggctactgtggctcagaaaatttaaacaagttactctagtttacaaagccagtggagttggaagtcaaacccaagtacttgggtttctaattccaaatcctttctttatgttagagtaagctcaacataatatattcttgaaagcaacttagaaacatacatcattataaggtaaaataaaatttatttatttacttttcttattgctcaccatgtgaagaacctgtgaacagcaagaaactttctttaattccctaaagaaaattatcttataccttgttatgcacctgctattttcagcatttatcctaaaaaatgtggcattggataattaaccaattatatgaattttatttaactgttttgttgttctaattatggggttaaatataattatttttctatagctttgtaaaggaaaacatcataagttaattttcattgtgtatcttggctcttgctgaggaaaatattcaaaataaaagctttgtcttacctaaaaatggaggaggatggcgtcagaatttactgtcatcttaactgatttctaataaggtgtctctgaacatacaggtctcacataattcacagctgcctttggtcttgattttttctttcttttttctttttgaaaactgaatatttttttactttatttaaagcccaatatttggataataaaaaggagacagggacatagaaataagtgtagtaaaaaagccagatatcttcctgtttgctctaagaaacttaatattctgtagcttgtatatagtcatgtaaataaagataaaattagttctgttttttcagtttaagttcaagttgatatttgaaatagcttttaaaaaaaaagttaagtcaaacccaaagaatcctgtaaaccttttactggaaatatttatggctatgatatccttgtccctttttctcatttttttgtgtaattttagccaggacattgatttcattacacaattgaagaatcctgtataattacagcatttaaatgaaatggaaaaagaattttgttactggtatttatctttttttccaaactgagaaggaacaattcttacagtgagaatctgccagccaggtctcagtgttgattataatcgtattttaaaaacataaatgaacgatttttatttaatcattttccaaaggatggattgaagcacaaaatctgttgcacacccagaagacagtgcaagaatggactgggttggggatgtagccaaccatctaattacaccaatagattcacagcacagttgggtcacaaattatgtttctaaatttagaaggtgaatctccaccataaattattgaaaagcactctgtggtactcctctctccatttcccacaaattagattactgaaagctataaagcatctttagaatgtgttttccttgctgtttaaaaatgttcctttatcatcaattagtgccaaccttgacatcagctataaccagaaaacattgaaaccaaaggataaaataaagaagcaaggaaattatttctaaaagaaacagaagaagcttttttacttgctagggagatttaactccttaaaatatttgtgagtttccatctctaaaattttcttgggatagaaatgtaatgacatattacataaatagggtccccagcacattttatttccttgctgatcgtattaggtaaaataattacagctgagctagaacaaattttgataaaataatttcattctaccataaattaagtcatttgcattatttgtccaactttacttttgatttgatttgattggttggttggttgatttttttgagatagagtctttctctgttgcccaggctggagtgcagcagtgtgatctccactcactgcaaactccacctcccgggttcaagtgattctcttgcctcagcctcccaagttactgggacacaggcacatgccaccatgcctggctaatttttgtatttttagttgagatggggtttcaccatgctggccaggctgatctcgaactcttgacctcaggtatccacccacgtcggcctcccaaagtgctgggattacaggtggtagcaaccaagcccagcccacctttagtttttgagcttatatatactcaccactttcattcatatgatttatgaacctgaaaaacagttgatggaagatattagaaaataagattatgtataacattacactaaatttaaggtttggcctctctatttcagttatgattttctctacaccacctctcttcctgtgtctataaaatgggaataacaatccttactgtgtacttacttaaatgggatgattcgcaagttcctcgttcacaagagatttttcaaattgttttttattttctaaattgaatatgcagtgatgtgccatgcagaactctggttccaagttaaaaatgtccaattcaaatagctgcagggtatttattggctcacataaacgatggccctggaagtagaaccagctttatatatagctatactcgggagtcacacatagttttatccaccttcagttttgctacaaattgtgttgtcctcaaactcaggttttctggtatagaaagatggcagtggagctcaagtgcctaccttttctgagaccttagtctagtagatttccattcccaggattccttggagatacttgttgaatctcagagattttgattaactcagcatgtccatttcttaacccttgctaatgagaaagaagagaataaagcttttttcatttcatatcccagaaaatgtgcatgcagttctgctcccatttttcctacagtatttcaagtgaaccactcagtgacaatcccatcaacttatactgccttactcttttaatttaatatgaaatagaactgtcattaactgaaagggaaattgcttcagtgaatatatttgtgaagaaataaaattgcttcagtgaatatatttgtgaagaaataaaattcatgagatattataaatttgatttgccttcaaaattttaatttaacttttaaaattagttacaaaatatagttttaaaaataatctaattattcataaacttttaattgagagtttctttctgattagttgctgtctgcccctgtgcagctgacccattatatttacaaattggttgatctctgcatataggccataatagttttataaactgtaggttataaacgtctgctctaattaattttctttcatatcaactgaatttgatgttgttgaggcattagtgagttttttaaaaatagtttacatagagcttcattttgttgattagtcaaaagtattgttaaactggcttcatggtgtttgaaatcacctattttcaggtgataagactttctaaattgatttttccttgttcctggatgggtcttattctgccagatgggagttagatcacttccattgaaagagagtctgcatgtgttcccagaagcacacacgtgtatgcaaatgcacacactgacactacagagtctggttcgtgtgttctttctcactatctgaggttgtgtatggccatacacgcctcagatggggttggtttttataaaaacgttaaggctgaatcatatttgttgtattgtgacatttgctgccttgccatcaaagagtaggtgcctttgtgctgacaactctttggcattttgccccagggaagtgttgcattatcaaaagagacgctcaccctctcagtgccagggtgctggtaattaaatcgtggatggttgaccagaattcacaggtgaaaatgatgaaaagaatgtattgaaatgaaaacctgaactaggcagcattatatctaatgagcaagaggagagctcttttaggcttggtaacttagatgagcatatgtgaactatggctaatgcttctgatagaaaatggttactaggaaaccataaaaaaccctctaattatgtgacctccaagctataccaataaatatagaattcagatgagtttgtgctaaaaccagtagtaacccactaatattattaatactcttgtagtttgtttccaaaggaagtaagatttattgtccttttaagtactggataacaattcacaaagattgaatttatttaaaagttcatagccaatgctactgtgttttaactgatgaattttggtttccttttgcagtgttctgtatcatggcgaaaggtcacaaaataatatcttgctatcaaaacttttttttgtggcttaactaggcaaaacttcgattaataaatgataagctgtagacctctactcagagtagtaacaaagagagagctggaggtggtggctcttgcttgtcactccaactcccatggagggtccttccttcttcaacctgactttcttatccccacagacctcatgtggaaccttgtaccatgggtgctattctgtggctgctgtaggatcttcccaggtagaaccagaccttatcctttttctttggtttcttgggagtagagctgaacatgagtgggtgacttccttttccaggctattggtcaaagctgcggtcagcaacaacttggccaagatatgcttgacccagttttgccacgggctactgaccaagaggttgctgttcggagttggcatgagtcagagaagcaggttaccagcaggttaccagctgggcaaaactcagatcgattagacatatcttggggtctttttacccctctctactcgtgttataattttttatcttaggcccctgcattccttcctctccttagccacaactgcctgatatctgttacttcctactaagttttaacagataaaccagactgaggttaaaatgctaagaattaactcctcttcccagaaaagtgtaatagaaggatactatagtggagtgggaatttgataggaaagcataaaattatattaaactggtaagtgaaaaaattttctacaaaaatggtgagtaaataaatagcattttggtagtttacatgctcagatgctttatttttctagtttttttttaaagcatttgtcttctggggaagcaattttataacaggtaatgtaagcttcctttgactgactgtaattgactaatggcaaccacagaaaacagcccttagccttcaatttttgctcccttgccagtaaatcgtcctgcctggggtgatgatttaattttcatggtattcaaattacaaattaacatttgcaagtgtagatttgggggattatgctggagcctagtagagttctctaaggatagtgtgtccccttgggctacatcatataacttccttattaaagtgaaaggaaattcccttttggttttcttacagcttttcttcctgtcctcatatttaagaaaggcatccatctattccactttaaatatcaagcttttcttatatcaagtatttcagatagtcagtttgcatactgcttatggatgaagttaagggttttggaaatgttagcctacagatttgcttttttttttttttttcgagacagaggttctgctcatcacccatggctcactggagcctcaaattcctgggcacaggcaatcttcccacctcagcctcttgggtagccgggactacagacatgtactaccacgcaccactgatctttttgactttttgtagagacaggatgtcattgtgttgtccaggctcgtctccaactcctggcctcaagtgatcctcctgcttcagcctcccaaagttatgtttgcttctaataatcatagttgttcatgagtagaaggtataattccagcccatcaccatactgatgataatttatagcattatttgtacttgtgtttgtagtttaacctgtgtggaattatagagaggaaacaaatcttttgacaggggctaagcttggtttcagggcagaataaacaatatttttttcaattatataaaattttgtagaattatggtaaatagcaactgcatttgaggaccaaaattcaaaggtttctgtattttatggaattcgaattcattctattgtattaagagtagattatcctggggccaggtgcagtggttcacgcctgtaatcccagcactttcagaggctgaggcgggtggataacctgaggttgggagttggagaccagcctgaccaatatggagtaaccccatctctactaaaaatacaaaattagcgaggcgtggtggcacatgtctgtaatcaatcccagctactcgggaggctgaggcaggagaatcccttgaacccaggaggtggaggttgcagtgagctgagatcgcgccattgcattccagcctggacaacaagagcaaaactctgtctcaaaaaaaaaaaaaaaaaaaaaaggagtggattatcctgaacccaaatagaaagtatttgaagggaaagactatgttttcctgtaaggtagattgagcagaaaaattattaaaacaacctaatgatctactgtgactaacattttgcaactcaacctatttaataggctctggaaaataagcaatgatttctagagaagagtaaaaaagccagaagaagaaaattaaataagcggcactctttctgtggggaagcctattaaccgtggaaaagaataacaaagttaggcaaaagaagcctacaacaaatcttgcgtatgtgtacgtgtgcatgcgtatacatacatacacacatatatttctctcagacatacgcagacttttcagtcagaaaaaaaaggctaaatgttggaaaccagtacttaattgatttttagaatgcaaacctaaccctttttgacatagattgatcctattacaaaattcataaaatttaaaaataaaaatctgttatgtaatgcttaagtagatattggtaatttgggattaagtttcagttaaaatggtaaagggagaattttagtggaagtgtttattgtaaaattgaatgatactaaaatattttgcttacaatttttttaaaagtccaaaatgcttaaaaagttttggtcatatccaatatttcctaaaatgtttataatattgtaacctggtagtgtgacatttgcccctcattttgttagcagctgtattatgctctctaataatacaatttcttttttattatgtaaatataacactgaaattagtactaggaaaagcaactgcgtgttaaaaaccatcatattttttactggcaaatttggactgaagttgtcactttgtcacttttgtcattgcctacctttatctccagggcagcatctgatcagagatctcccttaattattttaagatcactgtgttactgttagattttttaaataaacatttagatgaaatatttgattaaactgttacactaaaaatgtgtttaaactaatatgactttagtcagtttcctatgatgataatgtagcttacatgtaagggatgcatcttatgtaccagacattcagctagacagctgacatagattatctcatttcatcctcccaaatgtgaggatgagaaaacagaggcctggagaaactgagcagtgtggtcgtgatcactaaattagtaaatggttatgttttgactaagtatttcttgttatcatgtaatactatctatctcctttaaatagttataaaactcagagtttacaacttctggtcttaacattaaaaaaaaatcatctggaaattatgactatcatataaaagtatgttttaaccttcaaataatgatgttataagcaattccatcttcacagtcacccgccagtatttgatctctgataaatgaattgtttgttgcacacagcctcttagcttctttcctttgtctaggcttctggttctcatccactcttcatagaactgttttataaaattactcagacactaggttcacattattactcgattatttttaagaatgctgttaaaagtcaggaacctttatttatttattttcttaattaaaaccctcatacagaaaatgctcaatgaacatattctagttcttaacccccagatgaagaaataaaataatgccagtgcattagaattatagcaagcaagcccccaaccccaaccccaatccaaccttcttccccaaaggtaatctctatcttgatttctatcagtgtttttgtttcattttgcctgtttttatgctgtataaaatatcatgatattgtatatattcttttgtgactggcctttttattcaaacttaagttggtgagattgattcacaatgtcgtttataactttagtttgttgatttttactgctgtataatatctactccatgactgtgaatatatatgacaatttacttaccactttactcttgatgggtgtttaggtgtgtccagttttgatcatgtttaatagtgtttttattattgctgtttttcctatgcatagggaaaactttatatgccattaatatgccataggataacatataaatatagtcaaatttaatactcaatattgaacagttttccagggtgattgtgccaatgtatagtcctactggtactgtatgagagtgctggtcactccaattccttgtccatacttggtgtccacagttttgtaattttagctatgccactgggtatatagtttcagttttaattaaaatttttcttgaagagtcctataactgaaataaattgaactcatccttaacttatttctggatttatttcttacatttgtttaggattttagtctctatgtttacgaatgagattagtttgtaattttcctatcttgaaattctcttattagagttggcgccaagatatacccacataatgagttattcagtattttctcttttctggaagaacgtggtgttatttcttccttaaagttttgcaacagtttactgataaaattgtctgtgcctgcaggtgtgtgtgtggggcaaggggaggttttaaattatgggttagatttgttaaaaattgttttatgactattcaaatactctatttacttatatgtcagttgtgtatgtttggctagtcccttgtatctaaattttccatttttatttttataatggagaatcctattatatttgaagtctcctttaatattcctgcattatttgtttgaatttactgaacctctttgttctgcatattttttctatttaaataatttctgcagttacctttttaaaaaatttccttcagtttaacttttatttctttttctaagttttgaagtggttggttgcttattgattttgttttcctttatatattgaaaactgtagtttttcctctcagcatattatgctttagtttttcccagttttattatcatccaaataaaataattttttgttttccatttgattccctttttgacttatgagtgtaatacttgtcaaacccacagatgttatctgtttattatttattatgaatttctggattaattccactgggggtataggacatactcagattttaatacttggaaatttgttgagactcctctggtcaattatcctcaaggatttgtatgtacttgaagtcatgtgattaagtttttgttgcttgtgtggcatttactgagggaaatatgttaaaatctcccagcatgtctgtttgtctatttgacttttattttaaacatatttcattttcctttgtatctaatagtacttttttatggtgctaatttaactacactggttttcttttggttagtgtttgcatagtatatctctcattcatttcaaactttctatatctttatatttaaaatttcttttaagcagcatgttttagtccagactgaaaatacttgtcttctaaaattgtggtattaattcacttccatttaatatgattacagctacatttggatttcaaactaccatcatattttttagttctgaatggtaggtagtggcttaaaaagttctcaaagtcatctttttcctacttgaatatgttaagtatgtttattttaatatctgcattggatagcacattatttgtattacctgtaggttcatctgtgtcatcttgatttttgtcagattgtcttgtctcttcacatgcctagtcattttttaattgcatgtcagatgttctatgttaaaattctcagaaacaatgtgaggcctagtatgttgtttgaaattaacaagtcatttttcaaatgacagggagcattgctatacagtattgctatactggatcaatttaatcaaaattctgggattgaaatgattcaagtgtggtcttttatgttatctaggaatattttatgcttccttttatttctgtgttataacaccttggagtctcaatcctacatagagtgttttgatataaccccctctttggtgagttctggacttcaatttatgtcctctaagatttagtagattgtcaaacctttgtttagcctctcagctaccttttctgaaatcactaaactttccaagggtcaatgtgataccaaattttaggcttactcctctgaattccttcttatcctgtatcttatccctttaatactttcttgtatgtttgggatattttgggcacttaggatctttagcttgatgtctttcatcagttttagttgcctttaaaaatatttgtagagcttttttagttctttctacaagtgttgattctttttacctgatacgccattatatgaagtacaatttcctcttttaacaaactctaaaattttttttagtttcttgaagttctttgctttatgttggttaattttatattgcttctccttgtatagatgcaacatagtcttgtatatttctaaagattcccattatttttaaattgcttataggttcttttatttcttgaattatctgtatttcatctattattgatttccctcctgtttattttgatattgctttttatgttgcttactttccccacaaagtccttcactgtgatccttcattatatattcattattaagaaagaggaaatacattagagagtctgatttctgtggaggtgggtggggtttgtgaattttgcagctttcatttataattttttaaagagcagaatgtaaacaatacaaatgcactctcttttttctgggctgctagtttctgctgagtgggaataggagcaggatctactcttttggaatcagaatctgaataactcttcatacattcagatctgagtattagccgttgccttttcattccttgattttttttgagactaaagtctgtattcttctgtctttatttctttcccaaagtacaataatttatagctgtgtctgatcttcttaatcagttactaagcttctacccctttccacttctatcttttgtaaatttgttaaaaatcccttatccagtgatggactctctttctttttctaatgtggagatatatctatttagatgttatattaattttctgttgctgccatcaggaactaacataaatttagcaggttaaaacaacacaatttattattttacagttttgtgatctggaaattcagtaaggatctcaccagactaaaatcaaagtattagtggggcacattggctatgttctttgctggaggctataagggagaaatcagcttgttgctcatgcaagttggtggcagcattcaattctttgtctaagaatgagctactgtgttcttaacgatgaccactcgcagcttcttgaggttactcaccttccttgtcccgtgacctctatttcttttatgtatttatttatttagagacagggtttcactctcttgcccaggctagagtgcagtggcgtgatttcagctcagtgcaacctctgcctcccaggctcaagccatcctcctgcctcagtctcccaagtagctgggattacaagcatgcaccaccacacctggctaatttttgtatttttaatggagatgagttttgctgtgttgcccaggctggtttcaaactccttaactcaagtgatctgtccacctgggcctcccaaagttctaggattacaggcatgagccactgtgcctggccacagccctttttctttatcttcaaagccagtaatattgggtagacgtcctctcgtacttcaaattgcttctgtctctttatcattgtacatctctgaccgactcctctgacttcctctcctacttttaaggacaatgtgattaccttgggctcacccaaataatccaggataatctcctattttaaatttagctaattaaagcattaattccatctgcaatcttaattcccttttgccatgtagtgtaacacattcaacgaagtaagactaggggggtgaaaatcatgtggtcaaaaattctgcctgccacaatctgtggtctgcccactgccatgcactgaatgctccttcttacctttctgaagatcgtctgtctgtttcagggaaaccttattcttctcaatctccttatttctaccatttataatttccctccctcttttataaaatatctattcattcttatgcttgactattttctctttctctaagcactcttattttttcaaagagcttcaattactgtctatacaccagtgactttcaaatctgttatctgcccacaagacccatctgtaaaactacctacttggcattcctgtttggatgtttcacagtcaaataaactttaataaggccaaaatatctcaccgtcttcttccctactcacacattccaaacttactgatctttcctctttgttctctgtcagttaatggactcacattcccagtcagttatacagaccagaaatgtggtaatcatgtttgatatttccctctccctcataccctacctctatcagtcattgacctattaatgcttcctatcaactatcctttgaatgtttccagtttatctcactatcatatatactggtctccatctcactccaggcctctgctgctttctctgcctgaaacaactcttgttgtttttcctgctttcttgcctaagttatacttatcttttagacctctgataaatgtcactttcttggaaaagctctccacaaatcccagggctgtcataaaattctatacttgccatttatattaccgtaactataaatgattgataaattatgtaacttcataaaataaacattttattgttgaaaattttagatttacagaaaagttgccaagatattacagtccccatatattactcattctttttgccttatgtgttgttaatatctcatatcactatattacgtttattacaaccagagaacccacgttggcacattactgttgcccaaactccacagtttatttggattttaatagttttccccttgtgtcctcttcctgttccggtattccatctggtatacaatattgcatttggccatcatatatatccttgccttcctctggtccatgccattttctcagactttgtttttgaggaccttgaaaatcttgagtagtactactcagatattttataaaattccatctgttgggttatatctgtttttttcttcatggttagacttaggttataggtgttcagagaaagatcatggaggtgaagtacctttccctcaaatgatgcagagggtacatatcaatatgacttatcgctggtgatgtgaactttgaccacttggctgaggtaatgtttgctagacttctttaaagttacttttttctccctttttatactccactctttagaagcaagtcactaagcacaactcataaacaagggggtgaaatttaaactcctccttgagaagagggtatctacataaatcatttagaattcttctgtatgggagatttatctcttctccatttatttatttaaccacttacttagatcagtgtggacacatggatatttattttattctttgtgttacaattcaatactactttattttgttgctcaaattgttatagctttaaccattggaaggtgtaattttttttttttaagagaggggtcctgctgtgttgcccaggctggaatgcagtggctattcattcacaagtgtgatcatagtgtaatacagccttgaactcctgggctcaagtgaatctccttcctcagtctccctagtggctagactacaggcacgtgtctcttggcccagcttaattttttaaatgtctcttttcctggatagaatgtaaactacatgagtatgggcttcaggtcttctaaaattttagtgagaagcctggcacctggtaaaaatcaatttgtattttgtgcaaaaataaattcatgaatgaatgggatctgtaaagatgagaaagtatcattgtgcttatttaatgttgaatgattcctgtgttgtcttccatttctaagtgccagatatttctttatattctctgagcctccagactgtggtataagtacaaaccaagagacacaaaaatcaatttaaaagataaatctctgtattgtcagccttgagtttagatggatgacatcattgttaccttggtcatctgtctcacttcagacttttattcatgcatcttactcatcctgccatttctctaagtcttataatcacctactctacattgattcagacccacatctaattgtggtggcctctgggttttcccacagatagccaccaggtttttatgatttctagttttactccattggccagtgtgactaaatcaaacctgtgggaaggagctaagatttttttattgtggacctatgtatgtgtatgtgattttttaaaacttttggctgtgtgctgaaagaagaattgtgttaacttatttttaatattctgctactttccctttgggaaagaaaagtacattttcatggtcaaatatgggaactttatattattattcaccatcaattatagatctcataaatcaaaaagcagtattaaatgtcatatttgtaaatgctatttctgggaaataccagatctagtgttattttgggaaactgtgggttgaccttgcaaaactcacattaacgagaaaaaaaagcacattttaaatggtgacacatctaacagggagcttaacagagcaagagaaagtgtgtaggtgttcagtagtaacaacctaatggtaccacattgtatttcatgaatgggagcaattcacaaagttcccacaaataggacctcatgcaagaacacaactgtatagtggttttctctatccttattctatcaacattttatgagtccctactaagtagcagggaggatcctagttattgtgaaaataaaaatgagtgagttacaattccttcctgcatgtagctcagcttagcaggggaactcagatcttataggtaaatcattcatattatatattatagaaacaacgaatcataggttagatcaaccaggagagtaaaatcatgtcacccagcttgacgcccagatgtgttttcttgcatttaataagccagtagcagagaggaatataaggagctatgtcagaaacttaatggaggtgatctctgtgcatagcttattaataacgattttccaaatgttccatagtttctaagacaagtatatatatttttttaatttaagaaacagggccaggcatggtggctctcacttgtaattccagtgctttgggtggccaaggtaggaggaccccttgaggccaggagttcgagaccctgtctttaccaaataaataaataagccaggtgtggtggtgcatgcctgtagttctagctactcaggaggctcaggcaggaggatcagttgagcccacaagtttgaggctgcagtgagctatggttgcaccactgtactccaacctgggtgacagagggagacccccaactcttaaaaaaaaaaagaagccaaaccaaaaagccagttgttttaagctactataatctctaatttgtaacgataatttcagtatttccttgtgtttatttccatacgcttagccacttgtggagttttctttttgatggtattaaaataaaattctttcttttaaatcattaaaatgcagaggtaaaagaatctttcactacagacattagacagcctatgtgagaatctcttaaggcaggagttggcaaacgttttctataaagagccagatagcagtaaatattttgggctttgcaggctatatggcctctgctacaaggatttctctgctttttagcaggaaaaaaaccatagataatatgtaaataaatgggcgtggccatattccagtaatacattatttagaagaataggcggaaggttgaatttgccatagtttgccccacccctgacttggaggattcattaaaaatgcaaagaccaagttcttacaccttcctgaattagatttcagagagataagcctttggaatctgtgtgcttaaccagttgcatatattattaatattattattattacttatactcaagtttgtgaactttcattttatttatatactaggatatctgagtcctgaatttgtctctacagtattgctaggggatttttcatttagcttgaatagttactttgaacttttttttttattttgaactatatttatggagtacacctttatcagatggaacctctgtttcaaataattgaccgagaaaatatgaagggtaagtttctgttgagttaaagttcaaaaatggaaatgctgaaagaacaaggacctttttcctcctctttattgctatatttctagcacttggaactataaccggcacagggcaggtgttttgagaaatatttgtgtaatgaatgaatacacatttgtattacttcactctcggcatacagtgatggcctgaatccaaatggctgcactgtccctgtatttgatatctgggtaatcaagtcctagccatagcctttctgcttttacacaataccttttagtttttatccaatattccacctgtttgcattaattttggggttatgaatgctgcccttaattgtgctgtttcaacattcatggttccaaagcaacatctataagtatgaatgattatattagctaaggatcttttgactataatcaatgaaaatccatatggtcaacttaaacaaaaaaggtatctattaggaaaatgggttaggtgaaagctcagtatcaggggcctgctgaacttctctctggaatgctacccaacataactcagctcctaaccttatcctaactccaggcctgtgcacatgctgttctgtgtgccagtttttaattctgagagattgggattggcccagctaagggcaagtgcctgttgtttggtttaatttcttggctggtgggtcagggggaccattatgtaaccatccttgtggagagaaaatcagagattactaccagaaggatgtgggagaagagatgagagatgctaggaagatgcaactagtttagatatgttgattttggtgcctttaagaaaaaaaaaactttgcaaataactatttgtgctctgatttgccaaagccctgttttaaattctgctattaatgcaaaccaggctgcagacctctgaggtccatgctgattcttctctccaggcctctggtctgctgtgaacagggctgttctctaattgttacagacttcctctaaacctgaagatttgatttggagccttgctttagctgcctttagctggaagatttgattttgagtcctgtttttgcttttagattatatttatttataatatctatccctctctacttccaagaaaagattgttaattccagatttaaaatcaaattccatgctaagaaatgacacagatcatcttcagactgctccctgtaatctactcatctctggttctgtccttgattagctgccacccaaacagagtggcccagcatggtcctaaatccaagccataggataaggatcctagaaagagaatggagttctttcccaatttatgtccccatctcccacatgcgcaacccccggaagctcagtctttgttcctttattgcagtctgcaactactgacaggttctgactgctgtctactccaaaagcatcatgtatacttctccccactgctttttgtgatacagttccactggcctgctttctgttacagacacacagaagtctattccctctgcgtgaagcgggccttccttacgtatttacaagaccggctccttcatgtttttcagatctcaggtcaagtgtctccaacttagcaagagatgccttctcaaccaccctttctaaatacatagagcatgcctcctgagtcactctgtatccccttaccctgttttattttaatgttgcaatgatccctatgtagaatgtcacttctttgtatacttgtttatcgctttgttttcctgctagagtgtatgccccaggagggcagagatcttgtctctggtttatcccagttgtttagaacagcacctgatgtactgggtgttcacttgtaaaaatgaatgaattaaggccacttagcaatttctaaatcacctttgatatacaacaatccatatgcacagcaatccagatagactcacctgtctgggatatgtcaaagccacggagaagaaaactcagcaatcagcatttttcagactgtggggagctgagatcactggccttgctgaatctctggtcccagaaacaaatacagacagggatcgccagcattacttaacacccattcaaaaaaaggcattggggatttgcagcaacttttatacccatgttcttttgtcacccttctcagtatctgtatcagcatgtttgtagggttcagcagagaattttgtcaggttaggaagaagtaacatatggtagttgtgatgaaaccttagcaccaggcatgcctctaacattaactcagaggacttgttttcgattctttcttttatgaaacccagcctttctattttctgctaaatcaacagttcctatatacacatcagctttacaagtctctaggagacaatatttcttttccactaatatgtgtattcacagcccaggtgcacatgtgcatggatgcacagacaagggactgcattttaagaagttttggcagaagccaagccatagcataactcattaagacaacctatgacaatataagaagagattattttggaaattcttaaggtaaagataaaagacaaaacatacatcgagtggtctttagcaaccctgagttctttcctcagtagctcttcttggatagcacacttaagttttcatatcaaatagtaatacagctcacctctcactgactagagccttgttatgttttccgtaaagcttcatgctgatggatcaacctgttggtgaaatggtgttaaatggtcttaaaatagttcagaaatcaaacccttcaaatctttgggtaaagtctaagaggagcattatattagctgtacagtaaataatgctataaaaagactcttgtatgagttaatggtgttccacacacatcacttagggtgcaggaatgaaacaacttgttcttaacttgccaagcccttgtacttttcagcttcttatctatgttcttggaaatcatcaaagaagaaatggaggaaggggatagcatggtaacatttctctgaggaaggctatttctttccgtccaatgctgattgtgagccttggtaatctctctcaacttttctatgtgcatacatatatgcattttatggaagctaaattaaattacatttaaaaacaacaatgtggcaaaatgttaataatgggtgaatctatgtagagggtatatggagttcttagtactattcttgtacctatactgtaagtttttagttgtctagaaaaatgtttaacaaaatatcagcagcatccaaggtggtcacacttgtgcttttgcatgtcaggtatccatctatagctgcccctgtggcatgtgttttttcctgctcgactctagccacaataatcactagggtaggctgagctgaactgatgaaatcagatatccagggaaacaaagcaatcaaattttaatatatttctttatttgtacatattttattatctttgaactatagttttttcctttgggggagtaaggcaggtttattaccaaattttaagaagattttatgttctcagagcatttaaagcatgtttgaaatagataatgattattttatgtgtttatcttgagctgagattcatattctatggtttcagggtattagtgaactacttcttaataaacacagcatcaaacctgaaagtcagagacacaaaaacagtgaaatttaaaaccgtctccatagcaagaatctggaaaatctagaggagaaaaagtgaatgaataaggtagtatggaaggaagaaagagaggagaggagaagggtggaaaggggaggggagcaaaaagcaagaaagaaaggaaagaaggaatggtcaaaaggaaagagaaatctataaagacaccttgtatggatgttgctgatgtcacttattgggaagcataaaatgtaattgaaagatagtcacagtaagtgttaatagaattttaaactaaagttcattataggctgtggatttaccctgtgggttttgtggcagctcaggcttcaagcaaggcctgctgtagtgtcatggtcaggaggaatcctttgcctaacagagctcggaaggatcttgtggtggtcagtgaccagaccttgatcttttcacccagggaatccactgccttagtaacaaatctctgcaaatgggacaagagccatggactcttctgacccctgatcccacacaaagtgccatgtcaccaaatattctgtttcttgaactagtagggaattgttctgtgtataaagtgattaagttaaattctttgagtcacatttttacagagatttaagagttaattttatagagggtgccaagcttcttagaagcaagaatatggataaatatttttggttaccatttcccctgtcccgggagatatcttgctatcattatcagaaattacttttattattgtagaaagaagttcattctgtagccccaaacaaggcaaaggtggcaattggacaataaatcagtactttgtcaacatggagatgcatttttttctaattttactaacactgtagccagtcactatgccgccccagcccatgcagctgcataattatacatcagatctccaaaatgaattagtttatttttaaaacagctaattgccttagtggagtcatgttttaccagaagcacaaaagggctttgttcactgcagggaaattttcttctggaatgactgtgttaggctctagcttctgtaaatgtcagtcataaacagcaaaatatcagcaaaatccactaaaatcactaataatccagaacatctcaatgcgacttcagcattatttgctctgcatgtagctctatgtgattttaagattaaaatggcatagttaggtatgttctgtggtacaaccatatgtgactttttatgtgtgctttctgtagcccagtttagatatgtctcttgaaacccaactatgtgtttataaggcagacctcttattgcatgtttggtctccattagggatgacaagccaatttttggaaatcaagactcctctctattatagtcttaaacttcaatttttacattttgtttttggatgctattatatttaaatagaaatagcaggtgtaatgtttatgctatgttactctgcagggatagtgggctcagaaaacactgattaaggataagttcccacagtgtggcatcaccttgacaaattcacatcagtaatgcccacaaagactagtagattcaatcctaatgacaaatgaatactcacaataaaaagtatttccccaagggacaatatcctcatgacttaatgaccaacaagttgtaagaaaccagattataattagatgtatcatggcagaatattgactcaaacccatacttattagttacatggtttgagtgtttaatagcatgaggctaagacggctgactagatctgcctctaggggacttaaatgtggcaggaccatcacagacagcctcagatgtgaccccaaacccaacatgacgtaagtttctggactttctctttaaactttaaggcctgaagcattagtatttcagacttcataatgtataagaaaaaagccaaatgattatcatacagttaattttaaaagtccaattaaatatcttatttcttcccttaatatttctccctagaaggcaataaacttatctgtatatctctgtttcaattttttcttcgttctctgtccacacaggtcccaaatagattttattattttgaacaactaagttctggctccagttttgtattcctacctagaaaagcaaagcctgcagttagctaaaccctttctattgtttgcaaagttctgctttttaagtttgccccctggaggtctcatgttccatgccaaataggttttcaaagtatttacctaataattcctaggaaaacattctgctcctaagaaaaataatacttaccacttacaaatataggaattcacatgcctttggtactgaacaccctctcctcaaagtagactttaggtgggcattgacaatgttcaccttgacaatgttcacctttgtgctctgcattttctctgactccaaagctaacacataccccttctgatgaatccttcattaaacagattaaagtaattaattatattatagtcaactatgactaatctgcaatctactatatattttctaatttgagttagctcccccaaaacatgaatattaggacaataataatagcctttgagaccttacttggtccccactaagtcacagtttaatccagcgtgtcttaatttctaagcaaaggctgacaaacagggtgatcagttatgtgtgcgtgcgtgcgtgcatgcgtgtgtgtgtgtgtgaaacaaatacacacaggtgtatttatttcaggaaccaaaagactgcatttacaaaatatatttgagatggagatagttattaaattaaggccaaattgtttccatatggtgaaaatacttctttactagtaaaagatatttttataatttaagaggtttaagatggtttcaaaattcatttctcatcacatttccagcattcatgagcctttgaaacttaaagccagagaggagcttatcatttgacaaattacataagagttccagaatttaatgttatgtcgattcttaaaattggccattattcacaaattatatttatcacatgcgttcatgaaaatcaagagaactttagaataattatatatattcctttatctaatgttaacgactcacagcctgtaactaccatctgccctttctgccaatggtgtatttattaatatattttaataacaattctaatagttttcattttagcttaaaatgtgtttgcctaccacaactatacctgcatttttctatgcttgcttttcacactagaaaacaaagaccagtcaatactttaattgcccaagggttgtaaacagacatgaatgattccttaaagcaccaatcacctttaggaaaaaacaaacaaacaaaaaaaactttttttttttttgagatggagtcttgctctgtcgcccaggctggagtgcagtggcaggatctgggctcactgcaagctccgcctcccgggttcacgccgttttcctgcctcagcctcccgagtagctgggactacaggcgcccgccaccatgccccggtaatattttgtatttttagtagagatggggtttcaccgtgttagccaggatggtcttgatctcctgacctcgggatccgcctgcctcggcctcccaaagtgctgggattacaggcgtgagccgccacgccgggccaaaatactgtacttttaagtgcagtttatgcattttctaattctgtgctgcactctcaggatgatgggctgcgcattattagctcattccttttatgttatattacttagtttgaaaatcaacttttatttcagatgccatagtaatttctcactgttgataacagaattacaatgagaaaaccttgaaaagaatacatttagtttaaattaaatagaaaagaaaagaggaagataaatttagccaagattcaatttaggattgtaccagaatatttagttcccttacaaaatacaaagtattgctacttcaaatgaaaatttcttgagaaactctagccctcattaaatgaaatgtttgtaacaaaataaactttcactatcaatgtatcagagtccttattactcagcattcttaccaatacttggtattgttagactcaatttttgtctgtctgctgggtttaaaatggtgtctcattttggcttaattttcaattttctgattactaatgtgctgtaacatatttcatatgtggattggacattagagtttcttttccatcacttgcctattttcttttgccaactttattattgggttgtcttttcttattttttaaccattattaatatatattctgaatactcatttttgattcattaaattcactgtaaacgttttctctcaatctgtcattaatacatttccctttttaaaagtgtctttgcacaaaattatattattatatcatgtttatcaatctttttctttatgatttgtgttcttttatgtctcatttaaatcaattctttacctgagaatttaaatgtattctttgacattttttcttgtaaaacttttcaagtttgctttttgtatatatgtttaatctacttggaattgattttctgagtgggagtgtacatgtatatgtgtatgtgtagtttgatacaaaaaataagagtttaacatagagtagcaattatcttagcaccagttattgaaaatcttcccttctctgtagtgctagtattgatatatgtaaagcttccacatatgtgggacaatattccacatatgtgggcctaattgtcgttggtctattctgttctcttacctagttgtctatatttgaaccaataatgtattctcttttgtatagcttaacaaataactcctgaaatctgataaggcacataccctcattttaagttccttcaaaattatgacttttcttggaattttgctatttcatgtaaatatagaagtagcttgtcaagttaagaataatattaacactaaatattgatttttttctatccatggacaaaatgtatctccctatttttttctttattgtcctttatctattacttcttcaattcaggacactttacttagtttaactatcgctcaagactattttattaacattattttaatattatgtaatatggtaatggtttattatattacataatattgaagtgtgagagtaggcctgtgtgtgccaacactcagttatcctagattgcaatgctaagagaggtctaaaatctgctaattttagcttttcttctttctcctttattttataaattccactctgtcttttttttttttttttttctggaagattgcctgtttctagcagaaccttttcctcctttctatttttttttccctagtctgctgccaacgaactttttagaatttttttctgagataaaagtaaatttattttgagtatgaggtttacaacatactaattaattagctactagttgttgattaaatactgtgcaccagtgtttgtattagacattctaggttttcccagcaacactactattagggatagatggtaatcaccagtacatagataaaaccgaggataacatgccccagattatgaaattagagtgctgtgtggtcaagattgagtccgaatctatgttttttctcctagcaccaccctgcctctaacacataacaatattttaacactgaagtgtaatcagagacaatgtgctgtacaattctaaaaccagacaacctgattctgaggcaggatgggcacccttccctaactttggggccatagagcaactgctgtgccagaaagtttgtagggagggagagtggttaggtaagtagaagagacagagatacctgggggatagagctgcaggaggctttcaaaggtggttgtagtgagctgaataaagcatttccagtaggtcagagctgcagattgaggaaaggaaatagagttttaagatatttagtctgttctgctgcaacacgtgtttctataacaaaaattaaatgtgattggtacataggtgataatgagtataaagtgatgttggttcttaagtgatttttttctagtcatggggaaccagaagagtagaaatacaataataacttttagtaataaatgggaaagaaaaagccatcaactgggctgctacattgccaacaggaatcatttggagtatgtttaagaaattaaaaactagtatctgcatccagtgagttgcttatctcagttcctcgtgcccaaacttgttatgctgtaggctcatggcaggggacatttcctccaagcccacctaggctgcagccctgcagcagagctccagttctcccagcagtgcctcagtccccatcaccccgcttcactgtcctctctattgttttgtgcatttgtccatccactgtggcggcttctggccaagctgagctgctggttttttggagagggcaatccaacttttatccccacttaacaactgtaaatatcagtaataataataatattatatgataatgatagtgatgatggacatggtggtataattaccaaataacataggctttgaacagtttgcttataatcccatcatctcataaacttgttatttagagtacatatttaacagaatatgaattttctctggaacgcaattattgtgttattgctgcatacgtgtactgttacaggtctaatgtttccttcgtggtgttcaaaaattacaaataatggaccttacttacttagatattacttttgggttactcaaatggatattaactacaacaccactataaactgctgaacactatgggttatggttataagggttatacttggttctgtttactttgagtaccagggtatttttgtcttcagtagtcagattgtgtcaccccagtatccattataatacctaggaaatttattttcattctaggctttgaaaagatgataaaatgatgtaatgtgagttaatcaactgcagaatggcttactttcctatatagttaaagcaaaattatacatgacaaatgatgagttgtgatatgaatcttcagttcacccctcactgtggatctagtgtatacctttagcatatggagctaagtccaggctagattacttgccttgtgtagtctgaatgcttgaggttcagttctggatgggccacagtattgcatgaagacttttgtctggttgttacttcctcatgtccagatccttgtaattatttgcagaaaaatcattattagctgtgtctgtaatggcctgtgggtgactttatgtgccaagtcttcactaccagcattttcaaagggcttggtttccttccaagccattcatcaattgcctatcgccacatcatatatgccttgaggcatgatcattcagtcaggagcctctgtaactctgagtgtgctctgcactttctctgcaaaattaaggtgatggaaaagatcatattctgcttgttctggcaagaagggaagaggtctgaactgaaaacaggggcacaaccatggaccctcatgtgccctgtcacactgttaaagagtatccctggctgctgagcatagtggtgtgtacctgcaatttcagctgcttgagaggttgagacaggagaatcacttcagcctaggagtttgagaccagcctgggcaacatagtaagacctggactcaccaaaaaaaaaaaaaaaaaaaaaaaaaaaaaaaaaaaaattctccttggctgccacgtctcagggattttttttaaaaactattttccccttatgtggatattgtttgtatttttgtcttgatctcagttatcttccagcaataaatacttgagatgttattagagttatcaaatcttacaaatgattattacagaaggatagaaaattgtattgaaggattaaaacataaattaagaagaaaagtaactgagcaatgcccttatttattttttttcttagagaagcatcacacatttttaagacatttttttggaatcacagagcataacttttcttcctgggccatcgaatcaaagcattaccaagggagcattaacagctaggtgtgcctggctctacagctcatgggtgtcctgtccagtggcttgctgccctctctggtcatgcccactttgtgtgaacactgaaggcccttcttcccaggagccattggaagaactaacacttgtcaaagcaaatcatatttgttatctaaatatgaggaaacccttaaaaacagaacaaagtctaacgcattactctataagacagatttttttgaagtactgctctgaagtgtgactttttccactgctatattaagaattagcaaaagaaaaagatggtgaattatgcattatatagtatatgcattatatacagtaaattacgctttatatactacaaagaaagaagagagatgcagaaaataatatggaagctaatggataagaaatatgtgcttaagttggggcaagaaagtcaacttttgatttctgtgaaagaaaacaaaggcttcaatgagtattatgtaaatgggtgtctcaagaacaggtaatgattgctgaaatgagggagatatcatcttaagcaactagaaaggacatgtgcgaaagcattgatatacagacaggatacagtgattttgaagaacctaagtaaagatgagagcaaggttttcagaaaaagcagaataaaggaaaataaacccacagcagtgaattggaagaactttgaccagtaatctgtttgatagtggatgtgttttgaggattatttatgacctgtatcagtaggcattgttgttatgatcataggaaaatcctgggaaagagggtttttggaatgaagggtggccatgttgtctaatgtgtcttcttacccaggtcgccctatgttaagaagcttaattctagaaaattttaaattgcttctggatacacataagaacttctggcagaatttttctcatctggaaataaagtcatttaaaatttttacaaatcaagttctttctgttttttcatttatctcaaattttctaaaactgatgctacattggcaattctgttaaagttcaaaattaacaaattttattaccagaaaggcttatatcatgactgtctaaacattgtgttattggcacagattcaaaattcaaaattttgagtattattttaatctttctgttttctatcaactgatttgaatcacatacatttaaatgtctgaaggccaatatattctactatgtaatgatctacacagttttgagatgttacaataattcatgattcatttgaaagtgtaaaaaagggtactttagttttaccctaatggctaaatatttaaaatactgttatggggctgggcatggtggccactgtaagcccagcactttgggaggctgaggtgggaggattgcttgagccaaggagttcaagcctaggcaacaaagcaagaccttatctctcaaaaaaaaaaaaaaaaaaaaaattagccagtcatggtggtgtgtgcctgtagtcccagcgcttgaggggagaggatcccttgagcccaggaggttgagtttgcagtgagctatgattacactactgcactacacctgggtgacagagcaagatcctattaaaaaaaaaaaaagtaaatgtctataggtattgaaatacaaaggtagccccattatcatagaacttgataatcatgggttctcatttcttaacccccatattggtttaagtttttttgttcatgtaatgctataagcatgttttgagtgaagtgcatattttaaatgaaatcaaatgcctgaagtttttgaatattatgtctgctgagtgttttctccctagcttttgaaggggatagcattaacttatgtttgtggattccctgttaattagcccttagaaccatttagctcctagattttagtttcgtttaactaggcctcggtttttgaagtcaacacataattattcctaattgaaataatgaaaaagtattaaccaggcatggtgatgcatgcctatgtctcagctactctgaaatcacgtgagaagattgcttgagcctaggagtttgaggctttagtaaactatgattatgctattgcatggcagtctggatgacagagcaagaccccacctgtaaaaaaaaaaaaaaggaaaacgtaaaaaattttagttcatctagggttttgaatttaaaataactaaacttgggttccaaagggtcccttctgcttataagcaagtaccattgagaatttccttcagacatagccaaaataagacaacagtccctgcttcattacaaaaaacagattgttacagcttcaggtgaaataactaatgttagctgattgattcttaaatagactgtccctgccatctggagagaaaacattagttggggggaacacattgtttactgaagatattcctaggttcgaattaaatgacaaacacaggcgtaattcattgtacctaatgaaggctctgtatttcatgtgagtgttgttatcaagcttcgtttctcatattaaaatgtcagatttggctttataaaaagaatatagcaaatagcccagcatattccaccaccttcttgttcattatttccatatcttatttggcagttaggaatcattgaatcattgaatatgaatggtttgtttagcagcctacagagtgatattcatatgatgaaaatttccattctaacttttcatatttaatttatatatatttattatatatatttattttttctttaagaaacaaagcagactaatgatttttatgttctgttttatgatgtttatagctgatgttagttcggcaatacagaactcaattatcttagttcagaatacagaattctaagtagtccttcaatcatttagttctaatttatgtattaatattatattataatcataatgactactgtatattgagtgctattatgttatcataatgctaggaactttatatttactgtttctaaatattgaagctatactgaaaggcagatgttaatatccccatttataacatgagagaattgtgactcagaaaggctaagtaacgtatccaagttgtacagtcctgcataataagtggcagagacaaaattcatatcaaattctgtcttaatccaggcctcttatccatacaataagccacattatttgaaatgttattgtcttagtctgttttgtgttgctgtaatagaataccacagactgggcaatttataaagaaaagaaatttatttacagttctggaggctgggaaatccaagagcatggtaagggcatcttgtgtggccttcttatttcatcatcccgtggtggaaggcagaagggcaagagagcatgagaaagcaagagatggctagatttgcttttataacaaacccatttatgataatgacattaatccattcctgaaggacctaatcacctcctaaaggtctcacttctcaacactgttgcattgggaattaagtttccaacatatgaactttgatggcaaactataccagttatatagttctgtttcataaaaaagagatgccattattctcatgaatcaaatttaaattaatatctgaagccaaagtttccacattttccagaatatatctctctgatctagaaagtatatgatcataaggcccttccttcaaaaggcttagaccatgtaggatctctttaaagctgaaaagacagccttcaactcgatgacaatgtaaggtggaacttctttttattagagctttgatgttctcagagtgtctcatcaatgtgttctgtagaaaaactgtaatagaagccagtatggccgttagacagaaccagggagacccttaagagcatagaaacaattgttaaaattattttcagtaaacatagtttcagtatagaaatggaaatgttttaagtaaattctctggaatcttgaatatctaattcctgtgtttaattataggaaaataaagcataatataatttataatctccatgttttatattgataatatgaaacatgtttgggtataatttcgtccagaaaaaatattagatttgggaagggtggtaggtagaatggggaatgataatgcagaagatggtcaaaattgtgtgcctgacatttatttgtgaaaataagtatgaatggaagtgtttagttatcaaatgttttatctacatttctgtagattcatatgtatctattcaaccaacatgtggctttgccaaggagatcatctttggagagtgttttgggggatgaaaaggatttactgcttttagctccagagaatatggtgcaccagcaagggcttctatctcccttctgtgagctcaccaaatgcagagacttttatattggatataaggaaaaagatacagaagtaggctgcttataaaagagagtgatgcctaaaataaaggcattgaaaagttgaaaataaagggaaagaaaaatatctaccaggcaaatgtgaataaaaagaaagtctgttgtagtaatcttgaggcaaaagtcatcataagggacaaagaaggacattatatactggtaaaatgaaaaagaatttcccaaatgaaaaagagtgaatacaagaacatcatgttcagagacatggaaaaatgaaaaatttgggtaatatccaggaattgtgtctgttgcatgatgtttgcaaaagaaagttaggggttgaactcctaggtcaggtggttgtcaaaacttgaatggccttagagtgtgtttgcctctgttcttggcactgaaataagagaagtcctgaagtagagaagattccataaccataggatgtataatataaacttagtgatatggccagttgtaaatgtttgtatttagttatatgccattgctataaatacttttgatctgttgaaacataagtaaaatatgttttaggtacttgctatttcttaaattcaatagttcacacccaattagatcgaattatgaagtcagaattgaattgcaacattaaccaaaagttgttgctattttcagaggctagctttctagaatcctcttgatttaaattggttatagatcatggtgtggtatgccacgtatcaacttgacttttgtagcaagaaatgatgtaaaaagctctgggttgacttttggtatctgctacaattatgttagcaagtagtaacttagtcttgtcacagctctcaaatgtggtatatattcagatgctacacatgacagaatttttggtgttcagaatttccaagttgataaatattaaatgtgcagctacataagaagcagacttattttgtggaataaaataaacttttgattcataccaagtagtgaagatcagaatgctaatccttaactggacttctagaatttttttattttcatagtcctgtagctaaaaatagtcttttcttgaaacagagctttccattaagtttctgatcctgtgaacaccttgtatgtacatagcttagtcaacataggatgggttagtcagtgttaacttgcatttcaaagtagacactgttaaataaagaaaatagtgcttcattattcagcatgaaccattacgtgtcacttaaaggaaaagcaaggttttctagttgatatgtactgatacattcaggcatatgtagtacatatactaatgcaaaatgatgttaagttgcttagttatcttatatgaaacattagttttagggtcacagaaatgctgtttatacgaagtataaaaattgtgttataagtttctgtagtgacctttgaagggaggcaaagttgggtctgaagctgtaatatatttcttctagaattttgagcgcaaatggtgtattcagtgaaattcatgagttaaagatagagcatgaagacattagccaatgcagcttataaccagagttttctggaagctctgtcatgactacaaggttactagtagtacaaggttcattactgtaaagcagagttacaaacacatttttatattttcttagtgctgatatctgctataaatgcctcacaagaaagatattttaatactttgttcattcaaattgtactagataatgatggtcacattgagatcatttatgctacagtctgatgccaagtctttttcactggttggtctatgttgtgggacaagaacaaggcaaaggaaatgcaaaaagtgaaagtgcaattaaactgcacttgctttcaatgagattctttattcagttatatacttagcttttaattatggtttatttttgttattaaattaatattttaataagaaactatataaaatgaataacaatgaaatattagaggttgaatagtatgttagtgatttactcaagatcagtagtcacttaataggttcatctgaagaaggaatcatttattcattgcagaaatatttattgagtgacatactatgtgccagacattatgctaagctctggtaatacaggagaaagcaaaatgaactattttttcaagttgatgcatgaaactttttataactctgagtaaataattcaacatttaatcaattatataactttctttagaatttatacagtttcttagaaaaacaaatgagtaacagcttttcaacattttaataatcatgaattaaaggtccataggaggatatttttaataatcagttatagtaatattagctagtatttattgaatacctatttgccaggtattgtataattctctatcatccttataacaatcctgagaaatttattattttgaatccatgcttataaattaaaatttagggaagacttgaagaaaatttagttacagagtttcttatcaaactgtatagtaatcaccttgattgtattgcttctaaaactgaaaattccatgaaagtagggcctgtctcattcttgtatacatttatatcttcagggcttgcactgtggctgtgaaatagttgatattcaatatatgaaataactcactttcatagaaaaaataaacttcccttgattctatcaaaagactattaagttttccttatctctaattacaggactgcacagggccatattgatttctcctcctgtgctggctgccttgagtgctgcagagaggggctgatgtgcaactggaaaacactcagaaaaaaatagaacctggaacaaaatggctgagcagggaaaagctgtgcacacatgcccatcatcttaagagtacaatgctgctctcattcgcaagctagaggatccctttcttagcaatccaccttagtctttcatactccgaatattgatagccttgttcttacctagccttacctagtctaattattttcatttttaaaaattgttctctaaaaatgttggctaatttgaaatcacaccaaaagatactttattcttttatatttttgctgtgtaactcctgcttttgaaaggatgatctcatcttatggttctcaaactttattgtgcatcagaattacttggagggctgattaaaatacagattccttccagagattctgacttactcgttctggggtaggaaccaataaattgcacttctagcaagttcccaggtgattttgatcctctgtaatcctctaaaaatagaataaatcttggctcaacacatcccatttgaagggaagagttattttcaatcactgcaaggccaatgattctaaagtttttgttgtcgttgatttgttttgctttcaaatataacagtctccctgaaatttcaatgccaacgtgatttctcagaccctttacctgctgtaaaatcttgcgtcagatgaggaagattttctcagaagaccatttgttatctaattaggctttctaagtggggagaaatcacttgttaattgagtatcccttattcacatagaattgatgatgttcctctaagaaatagaaaattcagataaataaggtcttgagttggaacaaaaattagtacactgtactttcccctccatcctattccttggaggtctaagggaatcaagctcactgactgcaggcaaatgcatatagttttattgctttaacaatagtttgaggaatgtgaggttgggagaagaggtaacatcaatgagtgagtgagtgagtgagtgagtgagtgagtggaggagcagcagttattggtgagtaatttgcagcatactacaattgtagagcacaaattcggtatttgaggtaattaagttttaaatcttacttcatttacattccagaatcatagggtttgttaatacatgaaaagtctctgcttgattacagatgaactgatgatatatcattgtggtagaataaattgggttacattacctcctttgcttgtttccagttatcaactgagattgattttagaagaaagcctattataatccagaaaaatacaacttgaactccataatctcaagtgttgaaatcccaaaagatgaaaatataattctgaaagaaataataaaacattctttatatttatttacattttaaaagggggtttatttgagaaaaattaaaacaaaacaatacactgtacacgataaaataaataatggcacatatttttacaagcaaaaacactcaggtatactagcaacagtcacaccagtataacagttatgatgcagacaaaccgtatttataaagaaataggtcaaaaatggaaatgtataaatgcatatcactgtggttgataattgtgtgcacccagctttatataactgtagtcatcttaaatttccggatgaagaagctaagctttttggcaagatggatcaaaaaattcagtgggtcaacaacacgcatatagttacccaaagaaccgagatcctgataaattttctttcacaagcgcagatgtacaaaatctttctttcatttattgaagaaatttcgacatgtttgggttcagaagtactgcttatatgcaaagtcaacgttgtgataatgcagttctcgtggaatcaaatttctgatgtccaaggcattcgaagagaagcctgccctagttctcagacagaaaccagttcacctcctgtgtctgttctatatgggtccccggcagatcggatggtgcctgctaacattgaggggagatcttcttcacctaatccactcaaactcacactaatgtcatctggaagcaccctcacagacacacccaaaaaatgctttaataggtttctaagtatttaatccagtgacatctcaaattgaatccacaggtccaccccttgtcaacttggctcccgtaagtctctccttaaccatacttaatttccaagtaaagactgtaacagccgcctaacatgatgcaactaacatgatgcaataatcctgcatacgaccaaaaactaatcgcttcaccagaatgcagctttcaagatttcatatttgagattttaatatttcgagattgttattttcaggattgtagacgtgagagattttagacctaagggatttagaccttagggattttgtatcttttcagatttcaacattcaggattatggcatgtgggattgtgtctttcaggattgtgatctaaatccattttagaaaaggtcattgtgagctagaggtctgaggatatttctggaaatattttggtgccatacaggttttttaatactttttttttgcttatatgtctgcatagaaagaaattggattatggtaactttgaaataacattttacattaggatttaattcccactttcatttactattaaattgagaacctgagatttttttggcccttgttactttttttacctttttctttgacctatgtgtatataacatataatatttggattagtttgcaataaatgcttacttaattgaatttgaatttgttacattgaaactttttaaactacccatctacctagcctgacatttgtattagcttgttatagttcttgtaatagaacatatatctttttcccccacattagtaaactgtagttttataaataccccaaaagaaactgagtcacatttctttactaacattactgagatgatgtgggaagaattaactcaacattcttaataatggaaatatggtaatcaatatagttgatggttgttttgatgatacttatttttcttctgagaaacaagtggggttttttgtaagtatccaatgtcttttcactctaaaatattttttcattatcaagagttaaataaaagagaagatggctgatggaaaaacatactgcaagaatgcagggatgaaacgtaaataaacctcatgttaaataatggtcaaaatgaagaagacacattatttacagtattttatgtggaatgccctttcctggatcctttaagaactaggataattactaactcagtcttctggagttttattctattttttattttttattataaaagctgagagatctttttttatcaattgttgtttgaaggtgtaatttaaacttaaaaagacaaaagatgcataggcatattgtatcaatatggtgattttgttatctcttttgtatattcatcataaatttttgtattctgttaaaaatcactctgaaacagacagtgggtccatttttcatcagtagatcatattaaattttatttggaatatctcagataatgatttgtatcattttggtaagggacaagatggtgagactggataatataaatgctagacctatatggttagttattaattacctgtatttccttaagctactgtctttaaagcctgactccaatagtgagtccttttgtaatcaagcctccttcgtttcctcatgagtgaatttcaatgattgtttttcttaatataagaagttcttgttctgatctcaccacaaaaaaaatggtaactagctgagatgatagatttgtagcttgattatggtaattatttcacaaggtataggtgtatcaaatcatcaaattgtacacctgaaatataaagaatcttgatttgtcaaatataccgcaatttaaaaaatgttctttacataaatgttttgtagaataaaaaaaaaaaaagttcttcaaaagaaatctcaaatctccaaatggaaacaggtaaaagtggagctcccctggttccacggagaaccttttttgaggaaacttaggcaactcgcaggtaccttatgtcatgagacagagtttgaaaactacaattgactatctctaaatttcctcccaggtctaaaatgtgatgatagttactacttcagtacatcatccttaaggaaaattattaggtccacactgtttctatcctttgaattttacacataaattttgtaatcaaaagtttatttgtaatatcagatggaatcagataattgctttttgttttttccactgacaggaacataagattttgttgtgtagcttaagtcaaacgcagtttggaatatatattttttaaaaattgtaacttacatatccaaatacaatttttcaagaagtagagtattcagtagaaattaatctgtgaaagaagaggaattcagcagtggcctatttgatgaatgatttaacgtgcttatttcttccctttcatcaaaactctgtgtccccttgtttgccccctctgacttcatactctggagttgaccaagatccctcttccatcggattgttctgggaattttgaaataatctgctttttcctctctttcccctgttgcttctgatgccttagaattacattttcctcgctgatttagtttagaaaagagaaaagagcttccatgactagtagattatcacttttgggtttgctcttggaagtgacaagatgctaggatccctctttggaatgtaaaatttatctcttatatagaaaggatataaatgtagcaccagagactataaaactctgatactatctactgtactgtatagctgaacgccacaatgtgtctggtaatctattgactatcataaatgctatttctacagaaaagttaggaggtccatatttcgggcaaccaatgtatagctgaatgcagaacagtcatagttgggtactaaccatatatatgatttatccatcaacaggtgcatatgctcagaaattctgtatccataagaaatcagactactttcttttccttttgcaagtaaattgaatttagcctgagaggctgaggggaaattttcacatataagccacggttttgtgttttgtgttttgttttgtttatagatatagtactaactggatggatgcgataaaattcataggtggtactaagatacaataggatttgtgaaatggacaattgtcttgcataaatagcaagtaaaaaatcaagcctgtccttcataaaaattttattctggggtgtgcttgttttccaaaagtacctctgctaaatctcctgttagtcctgaaactagaaggcagaaaagcttctagtgctacagccaactgcagtgtagcctgagaaacaggcaacaaaaatagaacaccaggattgctgtgcgtgggtgaggcagaaaccacattatgagcaaaagcttccagtattattttagaaccaatacagagctctgtacttctctcctctctcttccaaaaacacatactacaaaaataaaatgaaatgaaatgtatgtgcatttgccctcttagaattatgattcttaattttttttcttgccttcctttctttggaagcgaatcgccagtatggaaacacagtgtgtaaagcaagcttcgagagaggaaagagttaattggttttaaggccctgcgatagagaattatggttggaaagatagaggctggacagctgggtttgctggggtatttttaaatgcattaatgcaggctccaatcactcggccatgcttgacctatttttggctcaggccgaccattgttctatttctgtgcctgtgggccatgctgttgttgattcatatgcaaatggattatcactcgctttagccaacttgagctgagagagactgagaaagggggaagagaggcacagacacagataggagaagggcaccggctggagccacttgcaggactgagggtttttgcaacaaaaccctagcagcctgaagaactctaagccaggtttaattggtttctttttctcgtgggtagacttaataattttctacgtattctgacaaagaaataaccccgaagcacgttcctatttcccacctgcttgtagtttccgggataacctaaactccagagagctatagcatccactctgtcctttctgctttgcacacaggttggtaacatgggaaaagtgtccaggtctttttaaaagtggatgcccatttgagcagaaaggaaatcattgtcgaagttgatcctctgctgcttctcctcagggaggagggagaaccagcgagggtagctcctggggccggtgcactgagcagtgatgaatgtttcatgtagctgaagtaagagtgactggaatatgctgcagacaatttacgagagtgactcctgtttttcctcagatggggtggctggacgagagcagctcttggctcagcaaagaatgcacagtatgatcagctcaggtaagatcctctttcataactgagacgttttaggtttgaaagggggctggcttgggaaatgcagctaagaaaagcacctctcttaaggaaattgctgctttttcgtgttgatgttgctattttcttggtgcgtctgtagggtttaacttagatcccttccattactgtttctgtgcatattcagtctgcttagggacagcagcttctgaatgaaattgcaaactattgcttctgatgaaagatgagactgagataagtaaaatgtagttgggggtgttttgcctttactatgcaactagaaaaaggagctgtgtactgattgtaagcctattctaataggactttaaaaatcaggtaagttcatattggggcttcagtttaaactgcagccccgctagcctgacgattttatatttactctgtgcctacagaagcacatctatttatagacctaccttctaaaatgtgtttgccacagagttataaaggtagttttcttttttccattatgtggctttttctcatcagccccaaatgaaactgtttaggatgaaataaaattgttattagcagatgcttattttaattttcttcaaaaacatgtgggaagtctagcattgtcaggcagatgtgatggcataacacacatgtaaatgtgttaaaagcaggtgcagcgttttaaaggataataggaacagattctaatttctagtttctcaaggagatgagctggtgggagattgagcttgtcagccttgtcaatttatacttactaaatgaacatactctccaggcagtatcacttaacgtgtaattattgcctttcatatttatttcctatggctatttcctaaagctttgggaactctttgtttctgtcctcttctgaatgtttcaacctaaaattggcttaaagttctcacttagatcccacttcccatgtgggcttaatcgtaattatagatcaccgcctagatttccatgataagaatgccacataaagcagtgtttactttgtagagctaggtgtgaaagaaatattccacaggttggcatgatgtctgttttggtgttaatacaccttcccatatggggatctatgtttaaagctagttttctttaaaccttggttagttatgttaattttaagatccttctgttgacccaatcttttcatggaatcagaataaaatatcaattttgcataatttggtatttatacacttaagtgacaggaattatgttaatgaatagtgcctgcttaacaaaagcaaacctaccagaatttcagtacagtttattcttatagctgcaaagctgacaagggctccgggagggtttaacaggtatgtctctaatgggactggtcatttaacttagcattttattttttaaaatatggatgaaccctttgaaaataactattttagaaatcttttcagcactatgctttatccttttagtcctcacttctgtgttacaagtttgatattttttttcatatggtagaaacatacatgccttccaagtagcaagtgtctgctgaagctaaggctggctacaggtgtttgcaagctttgcttttttctccacatctttgataatcacatacagctttacacccatttcagtagagattgtcattttcctagcatttaatggtttgtgtacaaagcaacaagattttcagacagggaagtgcttcaggctgtccatgctttggccagttctacaagaagcaacatttaagcagcagctagctattaaatgaaaagtgatgtaggttaacatcaactcccaaaacctgtctggtataaatacataatcactaagttctatttatttttaaaatgtgaagcataaaaacaattacacccttcctgccatgccatatatttcatatatgttcttaaatttaattcacctagtctttattgtatacttcctgtgaggcactggctctcaaagttggactcaccagaagcactttacaaaatatgatacctagattccactcccagaatgcctggtttaattggtatggggaacagcctggggattgaggtttttaaaatctccccaccttaaccttcagcaaactgagattcactgctgtagggctagggaacagatggtgatgctggtgaaccactatcagtagggtttgtcctttgagctaactgctaaattaggggtatgtttgtcttaatttagctacaaatcttgttcagctcccttttggaccagtggtctggacgtgattcataggcttagaagcagagtctttggatttgaaagagagaaaggatgcctggcagcagtgcaaaggagtggagagagcactgttctaggagtcagacactctgtattctagcatgagctccactgctagccgattgtgtactgatttttttactcatcttcaaactgaagaataatgatgtcctcctgcttgcctcttagcattcttgtgaggttcagatgtatcaatatgtctttaaaacgtatactcactattagaattgttgtttttagtgaatgaacctaagatcttggttttcaatgccatgttctatcttgctgaacaagccacatgagttacattgtaggtcacatgggggaaatgattgtttgttttgataatcagtttgccttagttatcttataaatcaactatttattttgttaccttggtttgataagagttgagatctttcctatgcagactatcactataggtaagagtagggtgtgtatgtgtgtgtgtgtgtgtgtgtgttctctgaaatgtctcattatgtaataaaggcaaagaagttgcacagtatgtgattgaacagtgaaccccaatcgcagatttcatgagattatttttaaaacattggttatgttgtgtaatttctttagcaattgcattagagttcccatttgttgttctagttatattggatattatgcactaatattgatggtttttgtacagagctctttatatactattggaatacaagttttttttatggttgtatgtttttttgatattgactcggccaggctaaacatgtttggtagaaccaggttctataatattgtactaatatattttagtttaaagttctataatattaaatcttagaattcagtgtgagtgacacattttgtcaagtacatccctacttttgtggcttgtgtgggccagggtaagtgataactgtggcagaaagtgaagcatgtacaaatattgactcaggtcactctgcaggagctggcaggattaggggtgttctcccattgccaagcatgttgcttaacacgttgggcagcagagctgtccagacaatattggaacaattattatgaaggaatttcctagagtttgtacagaagtaatgtaagatatatttacaataaggaaagctcatattttggccatctattcttactttagggtataaaagaaaaacatttaaatcaaagtcctgaaattcttttatatatcttcacccttttttgaatccttttgttccttagtgtatggtgttgaggggaagggaacattttagattcagtagtcacgtcacttatgtctacttgaaaagcagaatctaattatgaaaatgtaagtctgtgaaatgttcctgtcatgtcaagaatcacttctggtattccccataattactgttttgccattctctaactcaggttatcttcacttgcaagtctgttatcaattgagatagatgataggtatcaatcagaaatataattataaatgggctcattgagaatggagacaagaatgagtatttcatatttctaaggatgacacaggaggcataattattgttatgtccgttaagtaagaaaatccaataaaaccccttggaagactgaaataaatccaaattctgaattcaaaaaatattctaaatgatgattttaattttggagatgagcaattttaaaatgtgcctcataatttctcactactgataaataatgaagtgagcccaaaatagcatgtcagccagcaaacataccttccatccctgtcacccaatatattcaacagtaactgagcaaagaaaatgatataacctaatgcaacatacctcagaggctaacagccaaggcaaaaatggatgcagaggttctttgatcataacagagagacctgtctcctgggctgtcttagaattttactggcaagttgaccagttcctgaggattctcactaagattcccaaatctgaagagaagaaaactgagtaggtatcctcaccattttgggttgttcttgttttctcttgtggctgagaaatagtagaaatgaaggcttcagagcagcgtactaaattgggagaaagatcgatccatagctctttggaatgacgtacctttcaccaactaaacttagagattctgccaagaagaaaaacatcaactcattgaacccatggaattagacgtcttagtattgcttcctacaaatagagcaccttacataaattttatattaaaaaaagctgaaaggtgagatgataaacaagagaatgagatgagaaaggagatatagatctcaggaaatgaatcaagaatggaaaatcataatgattatagaaaaaaatattcattagaaatagaagaaaacagaataggcccaggtaaaaatctttacacataaagatgaaaggtttgaaaaaaatcagagtaaatgaaaaaggaaaacagttagacaaagtagaaattctcaaacatgaaagaggctgcttgacagtgaaagccacacagtgaagagatgaacttaaaacaaacaaaaaactaaattcagaagtagagaaaacattatcaaagtaacgagggaacactgaatgcatttaaacaactattggattgtgtttatagggcagaaaacagatattataaagtaggggaatgtaaaaatattaataaagctggccagtgtgaggtgttagagagaggtgagatggaaggatgtgagaaatgctaatatccttccctttctgagcagggacagactccctgctgcttaaaatagaaacacatacttaaaaaaaagattcaaagcactgatttttaaaaatagtttatttaaccttaaagaggtctttttggaaatagtatctcttacgttaaggaagtatttagtacatttatagttccttcaactgcagttttaaatctgcttaattcagttaagtttaaatttaaattcagttaagtttaatttcagtttttaaaaataaatataacatcagtgatatgttcttatttttataattttttaaatctatccatccatctcctgaagaattcatataaagataggaagaaataaggaaagatgctgtgctgtgtttggtgaagaggaggggctttttctttcagcatcatacctctttacagtgtatgattttttataataggcatgtattctatgagaagtgttcattacacacccccacacaaagctaccatgtcaaaatactaacagtgattaattgtaagtagtaggtatattagttaggttgttttctcctgcagataaaagaacactctagtcaaaatgacagacaagtaggacatttatcatgtgataaagtagttgggtggttaggcagcaccaggtagtcaaaaatggcagcagcattcaggtccttcatatagctccactctgctggtcttagccttggttggtgtgatcctaagattggatcctccaatggtcacaaactgacttgtagcagttccaagcattatgtatgtttatgcataacaaattgcagagacaaaggttggatcctccaatggtcacaagttgactcgtagcagtttcaagcatcatgttatttatgcacgacaaactccagagacaaagaggggaaactgctgtcttggcgtctcttttaaaggaaagaaatcttacccagacttctccagcagatcatcctttattctatattgactagaatagcatcacctgcctattctttcacttgtttttcagaggagtgggacccatgactgagctgggaaggcaggatacctaaacctgctcaagtttctattgggaagaaccaagaagcaggaggaatagatgttagctaggcactagcagtatttgctacaacgtggatattggtgataagaagtttcttctttgcaattttatttactttttagtttccacaaatataataaagtaaatggactatgtttataatttccctttcagttgaactatgggtgttgactttcttttcatgaagataatatatctgtttaaatactaatgtaagtattttttactagtattgaatataagttttttattaatattgaatagattgcctttcttagtactgtctattgttagaagaagccccctaataaagagactgaagtaattgtagaagaaactggatctctctaagctattaatcatgttttctgaaggaaggagagtcaacattgtggcctcatgccttacaagcatttattataaacgtgaatagagtattcctttaatgttggcttcgaggcacacaaaattttttttgagaaatataataatatatgaattgttttcaatatatgaaaggaggattatcttaaaaatactcagaatgtgttcgccagtaggttgtcacaagtattacattttaagaatcatgaacaatttttacaatatggaatgataagcactacattttaacattttttttctgaatttgaatgctttgaaaataatttaattgaaataaaagctcatgcaaatgactttagaaaagaagctttcaagaagaaattcaaaaatatgttggcctctgcctcaaatgagtgttggctgtgccatggtcccccctgtttttgaaaggaagctgaagtgagtggttagcttgggatatgtggtgtccttcctgttggcagttttccccttttcttttcccagtaagttggcaataaggaagcaaagaaagaggaaatgcctggtgttcctagttccattcttcttcaactaagttggttgcacaaaacaaatttaatttaaacaacatttttcacaatactaaacgacctacactttcaagtgttatcagagaacgttatgtttaggtttactctgagttgctatgattcatgaatataagaataaatacttcttgtgtttttataagaatatattttccattcattatcataatgttaacttttccatagtaaaataagtgatgggcttttcgtgtacagtgtttcttaaatacccattaattaaatccaatgaaaaccacttttaaggaagaaagaaatttaccaaaccacagagtgtaactagtcatttgcttatgattaaactttttgcatgctgataaggttggaaatacccacgactttattttcctgcttctccttatggttcaccacttgtatcagaaacttttaaattcataatgtatgttcattattgacccagttgcagccatgtggatgttattttcaatttgcttgaggtacattttggtgaatgtctaaggcatgacattttcaaatgagaatgtcatgaagttgtttcaaaatttgaaacttgatattaaaaacaaaataaaccccccaaaatccagaaaacaaaaaataagtaaatttcactgagttttcattaaatgacatcatagcttgggagttcttgctttagtaaaaatgtgtttacccagaaggttttcagggaaccccatgtagggtgaataagaaaaagctcttgtgttaagcactgttttaactttattcttgatgatgcttttgaaatctcataatcaaaattcaagggtgtattttaagtacatgatttttacattaggaactatccattttaagttagaaagttatcaccacccgtttttgtttttttctgtcatactcctctctgatcttctagttgcttagttccaattttattttattttgttttgttctgttttttgagacaaagtctcactctgtcatccaggcaggagtgcagtggtatgatcttggctcactgcaacctccaccttctggttcaagtgattgtcctgcctcagcctcccaagtagctgggattacaggcatgtgccaccatgcctgactaatttttgtagttttagtagagatggggtttcgccatattggccaggctggtctcgaactcctgacctcaagtgatctgcccgccttggcctcccaaactgctggaattataggcatgagccgctgcgcccagcctagttccaattttagaggtcagtgattgtaagcatatttttttcaaaaatttttatgtcattcttttattattgacacaatggctaatgtttcaaaagtttctctgtgtatcacttgatcatttaatcctcaccacagtttaataatgcagtagttgttgcagcaatattggtgttttacagttgaggaaatatattcagagagataagaaatttactgatggttactgtaggtaggaaatggcagggtcgtgtttaaatggcagggtcctgcccctttttctcaaaaaatatttagcataggataattctgcttggtactaaaaatgtggacacatttatatatgtataaacaaatacctagacagacttcttaatcctgggaggtttaaggcacaaataggcaagcatgttgaaagttttgctggaagatccttacttcatgttctcagtgctagataattaaattcgaggaagttagcactatccagggctgagaggagcttaaggaaaccaagcttctatgagcgtgctcttttccttggagcagatgctctggacagaagcagcattcctgatgcatttggcacctgtttgccagtgttcatgatacacagatcatgagggtaaagttagccccgcttcaaaatagcaaattattattaatgtattttggcaggagaaagtaattttttttgaaatgttagcattatggggttcatttattttgaccaaaaggtttgaattatactcaccttggcatttaccttgaaatgtaaggttaataaagcctatatcaccactcaaatcctaatttcaacttgcaatgtgaaattctctagccacaataaagatctagctaacataattcagtttctacttattttgaatatatatctgtccaatttgggtccagtttggacaatttaggtgaaaactggatggctgtgtttatatgtattatcatcatactacgttttactttatcttgagttaattttgctttattggatgaatgtcatatgttctgtaggtggcttaagcgtaaaattcacccattacctactaatccaattatgcaaaagcccactcttggctttccaacaggtaatttttatgatcttatttgctatgagaatcttgagccatcttcaggaatcaatacattgtaaaagcattattgattatcacgttaatgattgacataatttattgccttcctaggggaaagaagctttcagaagatcattaaatgcattaaaacctgcagatgtccacatgtctgtgcctctctttagcagcctgactcctttgggtcagttattcttagcctcggtatttctatcttatggcatcgcaggtctaagattagcttgttaggcgttatcatgccatatgagttacctcctaatataactctacactggaatgattatttatagaaagagcattctgtcatttttgggttatttctagtagtttaaataaagaagaataacattcaagtgaaaccacagattccttcctgctgccaaaatagcatgataactgtctgcttaaggggcaataatgttgtttaaatgtgtgcttagggtgattgcagaattctttttatctctgccaccttgagagaaaagggagagctctggtaatgatgtatcatgcttatggaaaggcaaagaggcggccttgatgctgtctcagagcacacaggactctggttgatgatgacaacaagagacacacagggtttatttttagaaacagacattgctaagctctccatttggtgttaatattgctcataaacagagcttcttggggctgttgacccttctcgtgaatatggcattacacacacatactgttttcttttttcactttgtaagaatgattctattattgaaagtgtatatatatctgtttctaaaaattaagaaatctaaattctattcaatttctcaattttttttttttaatcccatgaagcttgggtttaagaattggtttatgaaaaacaattgactattataagcacaataaatatacaggttaactataagtatgggaaaaaggcaagtatacatcatgaatgacttttaataataaataacaccaatgctcctagctttattaccacaatatataaaatatagccataaaagatactgtcattataatgcactattgtgagttactgatttaaatagatgagataaaattctcagcatatgagaaaagtaagtgtaagcctctgcttgctgtttgggtattactacctcttgatgttcccagcaagtctcatatacagtaaaatatgcagttttacatttgagaagtgttctctcaatttactttgtgtgcttaattcaaaccttagcaattgttactttgctctaaaattagaattgtgttttaatgttaaattcgcattttatattttactattaactcatttttcctaaatgataaaaatgttaaaatggatgttagtgcattttatgttaaacatttgccaaatgctatagaatggataacttatgcaggtcttccaaatattcattacatattattattattattattattattattattactatttgagacggagtctcactctgtcgcccaggctggagtgcagtggcgcgatctcggctcactgcaagctccacctcccgggttcacaccaatctcccacctcagcctcccgagtagctggaactacaggcgcccgccaccacgcccggctagtttttttttgtatttttagtagagacggggtttcaccatgttagacaggatggtctagatctcctgacctcgtgatccgcccgcctcggcctcccaaagtgctggaattacaggcgtgagccaccgcacccggctattattattattattttttgagatgaggttttgctcttgttgcccaggctagagtgcaatggcgccctcttgggtcattgtaacctccgcctcccgggttcaagctattctgcctcagcctcctgagtagctgggattacacgcatgtgccaccaagcctggctaaatttgtatttttagtaaagatggggtttcttcacattggtcaggctggtctcgatctctcgacctcaggtgatccgcctgccttggcctcccatgtttttaaaagataaatatgttttgtgttttgtttggttatctgctgaccattaggaatttccaaaatgaaagacaaaaataggaaacacacagtaattgaaatgtatcttaaaagaagtcaagatggaaataaattcagagagtggaaatggaagcaactgaaggaacaacataacatgttgcatcctgaccactcttttaatgagcgggtcgaagactttggaagatgaaattgtttgaagctttgggaactggggtgaaagagtcatttatcggttcattttttcacccaaaactgttttaagaaccaaccatatgacacagaagatacagctattaaacaaagcaaggagatacatggttggttgttcaatggaatgatggatggatagataaagctacttgagataggaattagtattaaggtgaaataagagaatggggtagaaagtgactgatagggcagtattaactagggtagctagggtagttaagtgaaggcttttgagtctgctaacctgtaaagggtatctttctaaaaaaagtagattttccttcaacgtttaatttggtctaagtcaagtagaacagaagcacagttaaaatagattaggaatggtctggatctatttcaatattgttacctctgctttgtggaaaggatggggaagcatttagcagtaggtaggtaagggaactggagaaaggctgttagctatgattttctctgtttttcatagagatcgtgaaccaagtgcctctctcttgtattcatattattaacttgaagtgaaggctcttttagaacttgttccctttccttgttcctaaggttcacccttgtccctcatctcacctgccctgtcaattgtgcttaacatttcttacccaagcagtatgagtcattgctagtagttcagtgaagcaaacagtttctctttctcagaaacccaaaagaaggggagcagagtatcttcgccagctgaagttagaagtcttagaacattttctcataaacacaatattgcacactttttaaaggagtatgaaatacagtattcatcacacaggcatttactgtgtacctacaacgtgccaggtatttaattcaggtagatcatgggtcaaatcacacctttgttaggcggctggagaatcataacttcccaagaaaatatttagcatacatagcatacacagtcgtcgttgggttagcaactggctagattcgtgacatgttgttacaaaaaaatagttgtataaggaagtatttcatgaaggtgacacatctattttttaaaaagggagaaacagctaagagctatttttcctcacacattatgctttgtgaatagggaacaatggtggatacacagagtaggttggacaaacatttttgagggactgacacattatctcacatgcttgatgcctcatggggttttccctcaacattccaattggtctaagtcaaagcacaattagaatagagcaggaagtgttctggagctattttaatctccacttaacttctgccttgtggaaggggtggggaagcctttatcaatgggtaggtgggagaaccaggggaagactgtcagctacgattttctctagcctcaagaagactgagaccgagccaaactcctggccaacgtgctttgtggattcacagtgtagcttgagaaaaatggttagtggtgacttgttttttcccccgagtgattatctcattcaatcagtatttattgagtccttgaaagctgtattttttaaatgaggctgcttgtttatctgtttttgttgttgttgatttcttagtctaagaattaccaggtatttccttcttctgagataccttaatgctctattccaactggtcatcactggggaaaattctcttacaagcccaatgcaaatgttacctaatgtctgacaccatcactgatttcccctcacctctgtaatattaatacttccctaattacgtgtattttttttctctttctcccttctctctcgatcctcatagtccttttattactctctttagaacatttccactttctgtcttacactgtgactgtgtatgtgtgtcctcatccccccaattagttatattataagctccaagaggaaaaggatcatgttttacttctatttttattccctacagtacctagcatataattgatccctgagactatttttagataaatgaatgattaaagagtacagtgttattgcacaatgtgtttttatacatttggtatttttaaaaaatgatttcttcttttatgaagaaaattactcctcagtttctttgtagatttgaaaaatgtagacatttttgaggtgttagagctttttgcccccaaattaaaattattcattatagaatgtaagcaggaatgacctccaatgctttaacaatgtgtgtatgaccctttaaatgcttcagttattcttaacgaagggaatttgggaatattcttatttgatgtgatttttcaatgaataatgaatgccaatagaaatttcctgggatatgtgtctgcattcaaaatgtgaaatgtgaaatagctaatttaagactgcctgaatataaatgcatactttttttaatccaagagaagaataaatttagttgtgaaaatgattacaggtgtacttttatgttattcaaataacactttgcatttaatactatttttcccttctcctatgtttttatgtagagacaattttcttagataaggggcaaaaataggtggatttttctgttaataataatatcaattggaaataatttatccccacaattgctatctagctcatctacatttattctgacattatttaattagctatattatttgacaagggggcaaggaatgatgatttttgatgaacaatttaatcaaaatctcaatgccaagggtatcagtaatttgaaaaattatctaaagtaaaatgtcagaataaggagttaacatagtgagatattaaggaaatatagatggaatgggtgaatcaatctctatgtacaactcttctaagagaagaatgagaaaattatctttatgtgtatgtgggaaaggaatggtatagggaataagatataaatctttcagggtagtctttttgctctattttatccttaaaacagcataaattaggataagggcattaagacttagaaaattaattgagttcgttgataatagatgtgtgggctgagaaaggagttagataataaaaccgaattttacagcataggtgttgaacacagtgtagtatatcatggtgaacaaatgtatgccagtgtccttttagtgaatttgcaaaggctgccaattaggctttcttatcattgttcatttgtttgctaaaagatgaacataaaaatattagaaaaaaattatctgaataccagcttaacctaacttttatattgtaagaaggaaaacaaccctcaatcaactgatacccgtagtacccctagtctctcactatttattatcccagtaattaaatggacattcttccacatccttgatctggaaagatcaatatctttttctttttttactttttctttccagcacatagtttcaaatctgaatatagttataactctaacgttagaaacctctatctcagttcagtcttagatgactacaaaccaaactaaattgccaggtacagtggttcatgcctttaattccagcactttgggaggctgcggtgggaggattgcttgagccaggaagtcaaggcttcagtgagccgacatcactccattgcactccagcctgggcagcagagtgagactctgtctcaaataaataaataaacaaataaaagaaaagacaaatattaaattgtttagtggacacaggagacaacattgttctatttgattatctactgcccagtcagcttccttgggcactcaaccaacaggtaacagagattatctttatgcttcaccagtcatatatatgagacccactttcttcacacccctgccaatatattggatattgtcagactgtagatatttttgccaatcttaaagatgaaaatggtagagaattacttttttctgtgaatttttctgactactgttggattcgagtggttttcatatgctattagccatatgggttttcttttatggagagagaattccaggaatgcaagattggttaaaggaaaaaagtctatcagtgaatgttgccctgttaataatgaattaagcaaaaaaaaaaaaaaaaaaatcttctcattagatgtagaaaaacatgcaataaaattcagtatacttccagcatagaaactcttattaaactaaaaaatagaagagggaagtaagtattgttgaccaaaacccattcaccctatctgaaactttatatttaatggtaaaattaaaatacattctctttaatgtcaggaattgtctttggatgtcctagtcaatatttcaagacatgagcattcaataagatgtattagaaattaaaaggaaaataaaataattgaaataataaagagttcacttatattgctcagtacaaggtcagtacaaaataaaacattgaaaggactgttttatataaaaaacaaccaaacacaaaatgtaatagtgctagcatttacatggcaaatgaaacttttatggaaaaattaataacattgttgaagggcatataagaaaacttgatcagatttgagcgatgctatgctcaggaataggaagactacatctttaaaaagttatttattcccaaattaatctacatatctctttgtttttaaaacagttttttaaaaaagatgcttgatgaatagtattaagtcagatacactaagtgatgtataacaagaagtaaatcttatttccacctcaactctactaaccattcgatttcccacctcatacatagtctgctgtaaatttcttctatacattatatgtgtattatatttcagcacaatgttgattaaaatcctgacaggatctatgaaggaacaaggcatactgattccagaaattcaaatatacgagtaagtgtgcacaaatggcagttttgtaaagcaacaaatggagagaagaagcctagatgtcaagtcatacaaagctgtattaataatgattatttggtttgggcagggacatgctcacatagatgacaaggaatagaatacaacgttatttttagtagctttgtgtatgacagagtttgcatcacaaatcaatggaaagaggacaaactgttaattaaatagtttgggaacaattaatatattcagtttttaaactcatagccaaatgattttgtactcaaatatctatgtttgcaatactgttgttatccagttatgcaggttacaatttaaatttctgcaaagcctatgtattgtatcatgcatgtaggatcttgcattgtatagagggaccggaaggaattttatgaagatagggcagggactttagtaaagtggttctaaactaggtgagagaagtacacaatgtttatctagctcaattctcaaaaaataacttgagaccaaataaaagattcagatctatgagtacgatagagtgaaatagagaggtgataatttagtcaaagaagaaaggtagataactgtatcctaaagcttcaccaagttagtcactgaatagtgccttaaaagaccaatggagaagtgacttttaagctgatgcctgagtgactagaagagcccagccatgcaaagatcaaaggacagcaattccaggcagggggaacagccaatgccaaggcccttgagaccattatgtatttggctgttctcagaataaaggccactgtggctacatcactttcaacacaatagagaggattttcaggaggtttagccaaatctgccactgtctgtgtggagataggtaatctagctgtcttctctggcatctgtaagctaggatgggttgcctagattaccgttaggtccctgccatccttaaaaatgttagggatttgactttttaattccctaaaccagatcatatcgcaagactatgtctttcttgaacctccaaaataattttgatttagtgggcaaataaccccagtaatttgtttgatactgctagtttataatcctacagattttaggtttagaaacccattcacttctagcttatttaaacgttattgcttattttgaagcttatgccatgtctgactttggcttagaatgtgttgccttttcacaaaagtgttgtggtctgttatagacctgtttacaaagaactatcactaattgttatgacttatctagcttagtttgatacctcaaaacaatctgagtcaatctttctttttctgtggtgtgtatatgcgttgtatgtgtatatgcatatacaatgtatgtattacaactgtaattgaactatttcatatttttctctgtagcaagttatgtcattcttctaatagaagtagaaagaaatagatggaaaatttgactatatgccaaatttcttatagcttagaactatttattaccatcttagtaatgaagattattatttgattgtttatcagaaatataaagttgtatcgttagtgttcatgtttttcttccaatctctttgcccagtgactacatttgaattttctaggtcaatttaaaattgtatttcacttttaaaaattcggacttattttgggctaaaatagaaatttcagttaagcacaataacagagatgattgtaaaaatgcagaaattccagttaaatattaacacttaatataattaattgctgcaggtcagctgcttaataagtaaataattgtttccagctatcttttttccccagtttattttaatcaaaataattttcttggctgtgtgctgtggcccatgcctataaacctcaggatttggaaggctaaggtgggaggatagcttgaggccaggagtttgagactatccagggcaacatagtgagaccctgtctctacaaaaataaaaacgaaaaataattagctggctgttgtggtgtgtgcctgtagtcctagctactccggaggctgaggtgggagggttgcttgagtccaggaatttgagtttgaagtgagctatgatcatgccgctgcactctagcctggatgacacataagaccctgtctctaaagataataagaaaataataacaataaaaataattttcttcgttaaactagtattttgggataagtactacatagtccttaggaatttttattcataactttttctaaactccagtttatagtcatatggttaaaatttaaaaacagaaagagagattatattggttattggttctaaagtcatattttattgggttttacacctactatggtgatatttaaatgatgccaaagctacatgttgcaatcaagataacaagagtattttttccttcttcctcattccaatcttttgaaatgtaatgcatggaaatttttctttcatatgttaagtgtatctcattgctgaatatagtgtgcctcactgaagtattcacttcgttgccaaaaacacatcagtcattcacaaatattcagtattctgagaatgaaatttttttttagctacttgggtagttggtgaaagccagtttgcaaagatttctaactcctacagcgttagacatattatgtggaatccagggctaagcagcagctcccaaaacatgaggtagagttctagatacattggacccttcaggccacagtatcctggaccaagatttgtagccagttaacagaatggcagtaagcagtcttctattttgtcagtgagatcaaagagcattataattttggagaacaaagggggttccatccctgagcacattcattagcatttaaaggaaatagttataaaataaaaatacaatccctgagttaattaaaacatggagtttcaacataagcaaacctaaggcttagaagattggttgacatataataattgcttaatgaatattcatgggataagtgaatgaatgaatggattgaatatcatccatttacagcagctgatatttcaagtgcacatgtgcgtttgcactttaaatgttctaggctttttatcctgggttttctaggcataagatatataaagaatatattttaaaagccaatttttaattttaaaacttaaagggaagaagaacttcttttcattcttcatgatgcttttactaaggacacattattatttttatgaatattaactacgtcatacttcaaatatggaggttcttcagtcacacttaaaattttttgggttgttttcttcagacaaaaatggctttgcagctgtgattttatactcttcatcctgcctgcgggcctctttctagtagggccacattgtgtcatcctaatttattatgtgcagtatagttagagaataaaacctcagatggttgggcttattgcgttggtttctaaaatgaaatttaaaagacctttaagaaggatttcctctgggtaaatatattcagttatgctcatatccatagaaaatgtaatttggacaataaaaggccaaaatcacttgagtctttggtatgttctggatagctggtgtttttagagttgtgatttccaggaaggaggatgtcaccttaccgccctagtcaatatcctatttacttaagaacagaaacagggaaaggacaactcaaccttcctctcacctccttcacatgagaaccccagaggatgttctgatgtgtgtcaaattcacattctagatagtaatatattaggctgggtgcagtggttcacgcctgtaatcccagcactttgggaggccgaggtgggtggatcacctgaggtcaggagttttgagaacagcctggccaacatggccaaaccctgtctctactaaaagtacaaaacttagccaggcgtggtggtgtgtgcctgtagtcccagctacttgggaggctgaggcaggagaatcacttgaacccaggaggcagaggttgcagtaagccgagatcgtgccattgcactccagcctgggtgacagagtcagactccatttcagaaaaaaaaaaaaaaaaaaaaaaagatagtaatacattgagcatctgatctgccttagctgaaaaatcaaacatctggcataatggtaaaaaattatatagaaagattacttaaaaagacatctgattttaggcttctttttctggcaacaacaacaaccaccaccatcaccccaattcagccagcattctctacatttctaatttatgtttaaataaatatgaatatttagtccaagataaattttttgatcaaaactgatgatctcacacattgacagatttactttctggtatttaaagacaaacatattcagaaaggttaagcagtgcagggcgtcatgtgcttacaggaattgatatcttttaagagtccgtcattgtgactgcctcatttcacggcttgccacctgactctgttcttacaaacgataaaagttcaaataatacattatgaaaatgcgttctgaggatgttttatttacttgctactttccacttgtagtttcatgtcaagtatggtcccttacacctggtaagaactgaataccatgtttgggaatgaacgaactaaaggatcagcttgtgtgatgcgagagctgcctgcattatttcctcccctccatttctcctcttttacagtctagagtctagtatggctgctctcatagttcttctatacattcattctaaagaattagctgtaatctattacacatcatataccaactttgttattctcttgtcagtcacatatcttttctcaacactgatttgaacatttgtccatctttcagaacacgatgttgcaggtagaagagtacaagttaagacaggatgccttaattaaagaagaggcctttactcctgttttcttccattctcacccctctgtttctgccagaattgtgacagcagggcagaaaatgggcttttcgtgcagagttgacaagatacagggtagtgaagacaagaatcttctttcacatgctaagaaactcctgactatacttctgaagtagtaattggaatgacagcttttctggctgaagtacaatttttttgttttaaaaatacaaatggtccctctcattttctattcccagttctttcactcacatgctcacacttacagttatacagtgttcacacatacatttttcattgttttctcatttgaaataaaatgttatgagaaattttcaccataagcaaataatcacttattttatttgttttaattgagcttttaaaaggacattatttattattatttcacacactcgtgcatttattgatttactctctcccacagtgattgatttaccggtatttatcttctccaactagactgacttctaatgactcatttatttgggaacttcttctatacgaatcaaaatcaagagtttgaagtaacccagaaagagacttggagagcccaagggatctgtgaatgagctttaggcagtttctgaatctaagaaaattgtctgcaaacaaatatatttgtgtacatatgcatttttggggagagactgtcaattccatgtcttaatactcaaagaagtttgtgtccctagcaaacgtaagtgatcaattttagaaagagtgataacaaatttgattatttgggtcttcagcccaagactaaaaggcatagattacaagcaggggagtttactagatttagactacctaaagacttacctagagccacagcacacaataaaaagcaaaaagaaaaccaacccatcttccaaatatagaaaaggtcgagaaattaatgcaaaagcttgtcccacctccattaaagccgactgctgtatttaactggccctgagggaaccacagtttcacaatgcagttacggaaaggccagtaatagccctggctggctcctccatgtcatagatatctttaaaatcagagatgtatctaacccattttggaaagcataccttaaaacattaaagtgtttttgatatttcaaggaaaaggcttccgacatgtgaaatgtttattttctagattctcttattccaaaatgaaatcaaacgtgtatgaagctgtgggatgtgtcgtttgccccttgaagctatagtgtggtagaaattgaatctttatgtccagaagcccagtgtctgtattattagttttgcaaacatctgtgggctctaagtgattgataaatactatgtatagaattaacctaaagtttagtttgaagaccctacttcatagatcaatatgaaaatgatgccagcaaaaaatatagtttagacattgtgccttggaaaaatatttctatttatattaatgagcttatgtgatgtcatcacaactcattctaggaaagatctaggtcagtgtaatcctatctagagaaagttaaaaaagaataattgttgacttggtattcttcgtagtcagaaacaaattaaatgacaaattatgacactattttttattacatgacagacaaataaaaagttaccatatattaaatgctcaagaggttaatatctataaagcagaaatataaactgtaaatcagtaagaaataccagtaactcagtggataaataatcaaaggctatgaataagacatttacaaaggaataaccaaaaataggcagtaagtatccgagaagatgatcaatctttgtcatgattaacacatcaatgaggtgccatttttgtcaacattatgggagtaaaaataaatgactagataatgcttagtgttgattgtggtttggaggaaaggggtgttgtcatgtattagtggaagagcacactgttcaaattttggagcagcataaattggcagtactataaaaattaaaaatctacacacccaacaatctagtaattccacttaattggtatacagaaatacttgcacaaattcacaataatttatgtaccaggatatttatcagcagttttatttataataatggaaaactgagggcaatctaactataagtcaatacataatccatactctgaaatacaagtcattaaagttattaagtaatgtctgaagatattaacatagaaggatgagctcaatatattaatgaatgcaaaaaaatgtagaatggtatacagtacatatagcatagtaagctcaactaatggattcatggtacttgtttccattattttattgttgtagtaggagcagaaaagtagtaaaagtattttaacccaaagaaaaaaaatgctagcatgaaaatcacagttcaataaagtgtttttatatcagtatgtttattaataattaaaagtattaataagtttacttcaggaataagattaatttacgtatctgtgagaaacttcgtgatatacatcaaaatattaaagtaatcatgctatatttttcttttcattctgaagaccacctcttgcaggtaactttttctattttattatactgtcctattctcctttctttacttagttatatatcacaactatagaagaaataggttacctgttacttgcagaaatgtcactcactattaatattactttgcaacacagaaaatttttctgaataattagaggcaactaagcaagcctaaatggagttggttaattaagttataaaattctaagggagtatgatgaaccatgtagacatatgagctttctgttctgcttttttatcaaatgtttctggcacctgggttttctcaactgcccttctgttgaatatgattttcgaattgatgtaatgaagagtggtgctctctggacaagtaagctgttcatttgtagaataataatatgtcaacacatattttccaaaataacagtcctactaccgtaaatgtcttggaaacagttacctgacacccagagagtaagtacaactagcctagagccttggtctgacaccaagcaagagggtttatgaaagaagatagcccagaaagctggagtcctgctctgctgtgtcgacatgtctacagctcagaataaaattgagtttcctgctttagccatagctgggtcttaaaataacctgaagaaattatagttctgattacatagaaagtgaaggacttagaacattctcctaataaagccatgagaatgacacaaagcttagtcatcggcagtcctcctctaacaggcgttttagagagaaaaatagaggtttgaaattggataatttgatttgaaatcttgcctaattattttaagaatgcagaaaacctttcttttttggccaaaaaaataatgatctggaatccaattaggaaagaacaggcttttaaaatgtttgatatctccagtaatggagaaaaatcatgtctttaaaattacattctgctacaaacctcattcttggatgtcttgctttttgcattttgaatggacaaatttaatgtaatttccttttggaaacatggcattggaaaagttagatgagatgtttaattttatgttggatcctatctaccagggtacagatttttaagaagaaaaacacttcttgtttcgttttatttcccaagggagatatctcacttaaccagatgccttgcgatttgtcacaatatagatcatttacacagaatttgtgtccagtcgtccatctatttgatttgcacaccatgaataaaataagcaaaatggataaagcttctaatactcccaattaaaaaattgctatctattttttcaccattaatatgctatcccaaatggcatttatcaccatactgtctcaccatatttattcgtatgctgttgttttctcaagatacgttcaattcagattatgtttgacttgcagccatatcaataatatgactaataataaacaacagtctaggatttccagtttttagaaaaacgataataaatttgaagtgaacctatattcagatttacattttacttagtattgtttttaaaaaaacattcaattaatattctgaaatgattccatttatttttactacaaagttagctggacctttacagcattttagagttttacacgaggtttagatttgactaagccttagtacgatgtctggaaacaggaggttgaatgaacatttgttgaaaggaaaaatcagttattgaaatattgtgtcttctgttatcattcttgagaaatggtggtgagacaacttagtagaagtgactaacaactacatatatacagaagacaggatgtaagtctccaaggtaatcaagaccaacaggaggatgttagaccaaaattaacaccgcgagaaatgtgttatgcatatattacagcccacgtgtgaaaatctgttcatttatagagagattgcttctctgtgaatggctaagttggctccactaagtacaaaaaagcacttagggccattcagaactaacagccacacactctgaaagactaaaccaaaagatacctgattagtaagtgctctttagatgtggggatagacgttttaacaaagaaaggacagggatggagaggactaaagctccgtgctgggaaactcttaaggagccagggcctcccaacaatatgctaagagtgcacccctagctgtctggccacattttcatttcttgtctcaatcctgaggattaatcatgaattccagtccagtttctttccaagcatataactggacatgacagagtatcttagcttctacatcataaagctcaattgttaatactgaaaaaaaaaaagcagggtggtttttttaaaaaaaacaaaaaacaaaaaacaaaaaaaaaaacatctaatgagcaaacaaaccaaacatgcctctcttatttcttgtcctgtctattttttatttaagcgctgtaggtgaggtaattgaaatggagcccatgatatgtcttaagaaggattaataacattcagtgaccattaagtgctatgaattttcaatgtataatgttttatttgtttctcccaggaatcctctttgtaggtggtaaaaatcatttaacaagtgaggaaactgagctcaaagaggctgaataactttaattaacaagcatttatggatgtccactgtatttaggccaaagtaaatgatgtagtgtcttgcttccaagagcacattgtctagagtggaggaaaaaggcaaagtaaacatgagagaataggtgctaaaactagactttgcaatattgagaaggcctgggaagcctttcaaaggaaataaatgaaggggagttcagtgtttttgaagatggttggaggacatgatctataatgttgccatggctggagatgacactgcaaaccaggcaggagacagatgattaaggacctttaattccatgcaaagctagtgactttgaacttctaaaggattttaagaagagctgcatgatcagaaatacttcttggaaaagtaactttagctgctgtataaaggatgggacactccttaaaatgggttgtgtaattatcacataacctctaactattaactagaagtgcccagcaaggaatagggagagaatagtaagagtgaactggaaggaccagaaagagataaattgggaattcatgcaagaggtaaagggacaaattcagagtctgagatttccacattcataactgggtagatgtgttgccattattcattcattaattattttttgagtgtctcttatgtgccagacattatcttcgtgccaaaatagatgacagagcaaaacaaccttatatatttgcccttgtggaatgtgaaatctacactgtttgcacatgtatatgtgtgtgtgtgttgggagactgataataaattataaatgtacataattatgtaattggttagaaatggtgctgttagatgaacaaaaggtagggcagagaaaggtggttcatgagttgggagagaaaggtgcaccatcacatagagtagttagagtaggtaatttttatgaaggtaagattttcagcaaaggattggagaaggattgttaaggtgaggaattacacaagagacagatgaggagatttaaatgtagaccccgccctcccccacctccccctccccgctccgccctgcttcccattgcttgtcttgctattcacctggactggcagaataagcgtggagcttggtaggtaacattgattgactatcacaaaatgaagtgtagagcaacactgagagtaggaaaaccttacactatgaaaacatagaggggaaagaagcacttcttcatctggctgggttagctattctcaggataggtactcaagtatggaaggtatatagagattgggccttggcatacattcatatctacacagatagcatctatttacctgtgtagtgaatgtgagcatgataattcatgtaattaactgccatatttcttgtagggactgaaagttaacaactttgtatattaatactctaagagaactctaactatagtctccaacaagaattgcagggattttaaactcataattactcctcagctgtaaatttcagatgtgggttattgctttttctcatttaggggagtgaaattgcttcagccatcgactttgtgatgaggcctgcagtcagctgtagttgagaggggtgctcactctctgctattattagtagtttgtccacgtaaagacaatcatacaacatgtacaaaagttggattcaggatagcaacatattatgttttgtggctgcaagatatttaaatctaacaccaatagcataacgtttaaaaacaaaaattttattgaaaataaagtttatgtttggggcaaaggaagattaagaggataggaatatatattttcccattcttaactctgtctctcttctagggattgagagatacagagagattgagagagtgaattggagtgagtggatatgagttatatagcactgcctaatggattattacctcccaaacccctgagttgaagagtagatggagagcctgtgtaaaagattttgggtagacgattttgaaataaaacttagtgacatacacacacacacacacacacacacacacacacacacacattacagataagtatatatatggaaaaatatgtatacgcaaggaaaatactgctgttctaaatgtagtataatgattttaatatactacccaagaaatcttatgagactttaaaatcattttaagatttaataatagtaatggatttaatttttttagtatgctattcattacaaactagaaaaatcctaataaatcagtctgaatcagtaaagcctcatagatttccatgcaataatgtgtttcctcagttgcttttacaggaaaataattactaattatttgataaatttaattttggagcaaatgtgttgacagctgaaaaaacatgtaatgacttggatagagaccagatataacactagaacaaataatattggcgacttaaaaaaatagtaactgatgaaaaaaatctaattgcgttaaatattttaaagtacctaaaaataccaaggattttgtatcttttgtccttttctacttgaaatttcttaatcattttggtgatcatacaagataaatctttaaaattactgtgtgagtattcttaaaataaatataattctttggttaaactatacttctctaaattacatgcagtcttaataaaataattcctatggatgttaatgttcattctaaacaattttgctcaatccatatttttgtaaactgcattgctttgctttttttaaaagctactgtttatatagtcctagttcccagtttttcatatatactgtattgtgtctttaaaattagaaatgctgctgaaacatagaatatattaatccttgatgaaatgggacctctctttgagtataggactgttgcctgtacaactaagtctagtctttcagaacagaataggatgctgtatatctgttccctggaacttagatcctttggccttggttctacctgactttgagaaattacaatccctagtttttgtacatgtttcacttactttctgcatacgatttctggcttacttgactcttaagttcttgctgccagtcttgcctctgcagcagtccacattctctcaccaccaaagacataatgtcttgtggcttccccacttttatctctttgcctgctactcaacatttgttctgcaccagatgaaagtcactgttttaggtactttttaggggtacataaataattatttccttcaagaagccagcaatctgcataggaaaggttcacaaagcaattttgaaataatttaataagtctgcataatggattatcacatgagctttgtaatttatactattttgttggaattgtatagcaatatttataagttgttactatttgagaattcttgtgtcttaaatcatcttcctattagactgatatacaagtctccccattgaccacccccaatgccaaaaagaagcatgctgtgaacactgcaaagtaaactattagaaattaatggtcactacctataaagatagcaaaatactaaaggggtggtattttatgagcaatggaaacttttgttgtagatatttcaactgacactgtgcctttattactactttatacctacatctgaagatccagactctagtagttgtaatacaatagatgcaaacagtgggaacatctagttcttgtcaatgtgtcaccaaaacatattatcaaagctaatctcataagggtgtcagaggaaattaaagttgcctttggctgcatgttataagaactgactgaaattttaaactacctcagtagctgactatatacagcagcaggaagccttcaattaactgcaccagttctatttgtagtacaaaggatctatggcttaggatagcctacataacttaaaaagaaaaaaactcaactagatcttaacagtatcctgaagtacagcctgagagaaaaggatagatagggtcagataggagcatggagcatagtaactaattcaaagacaagggggtcttaggttgagctttaaaaaatgttctgtctagtcaataagaaattcagagacaatgtctttgaaagaaaggtaagccagaatgaagagtagcagtctacattctagagattataacaataaaagtcagcaatattaaatgatttagtatagaaaaaggtgagcttttacaagaataatggatagaaaagagttcttgaggttattaagtagaaattcacatggatttaataatgaaagatcatttccacatgatcctcaggccctgtttcttggactgtaattaagaagaaaaatggaagaacactaagagaaaggactaggaagtggtagtggctctaatgttcttcttttaccttttgaaatgctacctgatactaatttttgagaaaaatttgttggagagtgaaacttgcatgtcttttggataattttatttaaaggtgaatgatctcaattttaccttctttgtttttcacagttgcctccctctccttttgctatatggactatatgtatctaagtaagttaatgttggaaaaaagtttaaacattgagaaaattactgagggtgtctgggtaatatctcagaattagatttgaaagtcactgaacgatatgttgtggctcaatgaggaagttgttagatttgtgataataccgaaaaaaatccctcttttggttttatctaaattagcattcacaatacaaaagtcattctaagaattataattaggagtctgacattttacacagaatttggtagttatttttggtaaataatttttacagaggatgtttgatcaaattaaaatgtaaaaattttaaggatcaacctatgattttcttgtattaatatattcacgtgggatctaaatgctgaaaaattgtattattattttttctagtttcaaatctaccagaatgtttatctataacaacttctatacagaagttgtttaaagttcatggaaactatcttctgtaggagacagtttacagtttacagttctgtaaaatgaatcataaaatccagaattttgctccacttgtcccattactgatccataaaaactggatttaatttctactgtagttatttttaaaaaatacacatttggtaccttaagaatgaaataattataggtcgggcatggtggttcacttctgtaatcccagcaatttgggagggcgaggcagtaggatcacttgaactcaagttcaagtggagtttgagaccaggctgagcaataaagcaagactcagtctctacgaaaataaaaataaaaataaaagtaaaaaagtaagccaggtgtggtggcacatgggaagctgaggtgggaggattggggaggtcgagggtgcttctgtagaagttttccatgaagtatttttttttttttaaattaggtcgaattaatttgcttatttttcagaaaatagattttggagctggtaagaagaaatgagaaatactaatatagcatattagaacaaataacattttatataagtgaaaacagaaaaaaattaggtaaaatgatatatttataagcccagtgaaggaaatggaatgaattatcttctgggttttcagaccaaatggactgtcagatcctttagttaaaaatttgaaatatcacctttaaaattaaggtttagtcttctcttctttgccactttacttacttttcagggcattaaaaattacttagcaaactcataattatgtaccagaataattccctttaataggaattttattctaggaaatcatttctaaaagtgataaaattttaccaatttacaaatacttttgtactaacagtattaataacaatgaattttatagtagtgatagatacataaggagacaggaatcgatgagcatgggacttattatggaatatagttgaccatgtttcaacatatgaagtattattagaaagtgatacctctctacctccactcttctttctaactttaacaatttcctgcccagtctagggtgtgcatatttggaattatacctatttacaaaggaaccacataagtaaaaaacatgagataaaatggctattttagccatcagagtttttctggggtatttgtattacatttctgttttcttgcttgatgtctttatccttctgtcatgtgaatctctttattcccaaacatttgtctgggtattaaaccttttttcttatatgactcaatgttaagagagcctcaaacagctaaacaaaataacaatgagtggaaaatttctgtagccaagaagaaaattaaaaataggagacagaaaataaccagagaagaaaaaaaaaatcttttgaaaaatggtcaaatgtcatccagataaccttccaaggaaagctgcctctcatctccttcccccttcttttccttcctcatcttcctaaggttgtcagttggcataggacataaaagtaaataaaaagatgggcataaaagcaaatcaaaagtggtaggaaagcagccaataaaaatggggaggtattgtcccagaataaggacagagattttactttagccaattccaagttaagttttcatccaacacttagtttggtatttacatgaatgcttgtatagatttccaaagtagatgccaaagtagattgaggaagttagtggattagtccctagggtttgtttgttaaaagaatttgagaagcttcccataataactttaacataacagaaaagaaaactgataattgtgtgtatttcgtgtatttatggttatatacattatgtagtttatttcatccatagacttgttttttctcaatcatttctttagttgttttagaattaagaaaatgcattcatacattgttgaggaaagagtcttgaactcattggattcaccaatgtttaaaatctttattgcaccaatttttttaaatctttattggttttcattgatctgatgtggttcatgattttccatgacattcactcttttaaaatgaatcataaaatccagcattttgctctgcttgtcccattacttatccataaaaactagatttaatttctactgtaattatttttttaaaatacacatttagtgctttaagaatggaataattacaggtcgggcacggtggttcacttccgtaatcccagcaatttgggggggtgtggcaggaggatcacttgaacccaagttcaagtggagtttgagaccaggctgggcaacaaagcaagatccagtctctacgtaaatagaaataaaaataaaaaaaataagccaggcatggtggcacatgggaggctgaggtggaaggattggggaggttgaggctgtagtgaaccatgatcatgccactcctgttctgcctgggcaacagagtgagatcctgtcttaaaacaaaacaaaaaagaatggaacaattataaaataatgtatgttctatctgaaaacaatgtcgttaacactttatggaagctgtccccagagttgagggacacttgctgatgtgaagttagccaacacatgactgcttcagaatagaaacaatgttcaatggtgttgaacaaaaaaaaaatgcacccttgctaaagctacttctaatgctgtgtagctctaacaaatgatttatactggttttccatttaatgagctggcagggaggatttttagctactgcaaaatcttctagaaaaaaaagaaacttgttgagaagtctctgaaagggtgtgaagtttcttattttacattcattaactttttattttattcaaagttcagaaataggctattggtcatgcattgtgaactcaccatctggctccatccagcttcctgagggatttcccccagtgtcacagtcttctgatgtacttcatgtttgtaaaagttttgaatgcttaattatatatataaaatatatatttatatatgtatgtgtatatgtatatataaatacatatatgtaacacttataaaagtgtgagaatttaaatatagatacatagttaaaaaaatcaatcggtatataaaggcttacagtgaaaagaaattatcctctatttcacttcagcttcagcccgactcgtttcagtactccagccctgcctcccatattagccattttaacaattttttactcgtatgcttctagtgcaacctctctgtctttaaataatattcttgctttattcactttcagcattgtctattgacttaatgcatggtaataagaataactcaccaatttttctcttttctcccctgcttcaaactatacttactttattcttagttcattcatttattataataattattattaattagtgttcagaaacctcaggaagaataattctcttaactggtttctaagttgttgagatatgtgtggatctgaatgatttggaaagtaagtaagtggactagcaaactgtaagcatcatataaatatgctttattaaggaatgtggttacactcaaattactcttttacttaagaaaataagaatttaaaccacttgacataaactgcaggaaattgttgaatgatttatcttaatttaatttctttaaattctttcctgtgatgtgctaatatgtatgtaattaagaaccaaatgagaaatgtactcttgaaaaaaactttaagttttgaaaaccttataaaaatataaaaagtcatttttcccctatgattaaagaaaatcaagttaatgcatgacctatatgttgctccttgacagtctttaatagacaaaatactggatttcctataaataagaaaatggaaaggaaaaaatcctctgttcctttcatacttttaccccctaactctttaactatacaatgtagttcggcctctaatgtgcttgtgtaagcaaaactcaatacccttaacctccgagaaccacacttctactgttggagttctattgaactccatttcaatgcaaacaagtaaaggaaatgtttaaaaagttgacgtgtgatgagaaatgaactcttttatgttttgtcaaaatttggtgcttctggaaaaaaattgtcaaatacattttttggtccaaagctttcattttatatttaaagaattaaaaggctgggcacagtggctcaagcctgtaatcccagcactttgggaggccgaggcaggtggattacctgaggtcaggagtttgagaccagactggccaacatggtgaaaccctgtctctactaaaaatacaaaatattatctgggcatggtggtgcacacctgtagtcccagctacttgggaggctgaggcaggagaattgcttgaacctgggaggtggaggttgcagtgagcccagatcacaccactgcagtccagcctgtgagacgccatctcagaacaacaacaacaacaaaaaaccaaaacaaacaaacaaaaaaccacaaagaattaaaatacttccatactaaggcatcacattttggccatccaggaacactgttgcctacagtaagattatgagctctcctagaggtatgattctaaagcaagattaatgcatttgattatttctggatacagggatgggaagagaagtggtctaattattcatttaaaatataccaattccaaaaattaatttgttctttcttgtttaattatatgattttcttagaacatcataaacttcttgtttatgcctcttctctctactctgaatattgactatcgtgagagctgttcaggcattaaacaccgatttgaattttgggttctctatgagtgaacaagtaaaattatcaaaacgttatatattgatcctataccgtttttgttttaaatcaaagtaagtcatgcatttagtttaaaaaggaaaaggtcttttaatgaaaatagcagttctctactctgcctctccccaatcctccttttcactccacagcagcaactaccttcaacagttctggctttcttctgtttttttttttaactttaatatttctaaataacatatccgtttagaaaattatttgtttatgcattttaagcactatgcattgttttctcagcctgtgagatgaggaggttcccctgtacccatatgtgttcacccacaggagtgtgcttgtgtgtgtgcacacacacaaatatgtacacttttcttctctactcttcccagtagttgaatcaaatcaatagtatttatatgactagtcaaatgtttactgctgaaccaagtcatgtattataaccatgtcaattttcaagttcaacttaggcttttttctgaagttcattgcaaaatcgtaccctctatttatctggttttgtatacttgcatgtttctaccatgtgcttaaaaataaatattttccacacctgcagcacttcaactctattttctccgggagtttccagccttctttctctattgggaactaattgctttaggctccccactcatccttggtctgttcctttgctgttcttttgcgtaatcctctctttcttggattcttgtagcttctttgtcggttttatttttgttttaattttcagaagaatattttacaatagcttatatttgttgaatttttacatacctgaaaatgtcatttttctatctttttcaatgatagatttgtatgactgggcatagaacccttgtggaaaattattgtgagttctagtcccaatttgactctctttcctttgcatttggcttccccaacacatttggaagctttttagaatcttctctttatctctgtggttctaaaattgtataacagtgtatcttaccttattcattttctcggttattctatggcctctttcaccttggaggcttatgttttcagtatttagatactcactcgaattattttcctttctttaatataacttcttctcctttgtgttctctactcttatttttctgcagttcttactagttcagtgttagaccttctgattagagtctaattgtattttctttcaggtagatttagttcactttgtcttcaagaacatttagtgacattttaatttaagttactgagtttttaatttcaaagagtttaaaatttttttttaagtttttcatcaaagtgcaccgttctttattttaatgtagtaggtaacttcctctattcgatagaggctattaattatagttaaccacattttaatttttctgcgtgcactttatactttttctctgctctcctcctttcatgtttgttttgatctctcctgcgtgttgggagccttcatatttaaaatgagcatttgatctttggaagctcatcatttgtgtggcaattgtagcatagaggggttctggtatagacggcatggacatttagcagccctttcagtgggtacatgtgtgtttgtgtgtatgtggttagaaagaatccttgcatgtgcaggcgtgatggctcacagctgtaatgctagcactttgggaggctgaggcaggagggctgtttgagaccagcctggacaacacggtgtgaccctgtttctacaaaacaacaacaacaacaaattagccaggcatggcagtgcatgcctgtagttcctgctactttggaggctgaggcaggaggattacttgagccttagaggtcaaggctgaagtgagctatgattgtgccactgcacttcagcttgggtaacagaataagaccttgtctaaaaaaaaatttagagagagagagaaaaagagagaatccttgcgtactagtgtctgcatttctcaccttatgagtcgttaggtgtctcaaggaaagaattttcccagcttctacttgaaggcaacgtgcttgtttgccagagctggggaagtagatgggtgagtgtgctttgtggaactgcactcgatccaccactgtgcagctcttgtgtcccacgtttctgctagagctgtggcctcacctcagttttgtttgtccagggaataactctttattcttctagtgaaaagaagggtagtaaatacagagagtggcagggacttagagaggaggagaaatgtcttggctgtgagggtatgggcatggtgatttaaggatgctacaatcagaccttaaaccagtccctgcgcttttgaccttgcgcttgaccactcgtcttcctctgtgcctttctgcaagttctgaacctcttagggattctctggcatgaggctgcttgttgctcactcactgcagttacttcgggttgtgctttctcctttcagtggggctgttaatcactatccaactcactttccatcttcagcaattcactgaactctcctgctcattcttgtcatctcttccctcttctttttttgctgtaggtttatagcattttaattcttttactgtcattttatggcatttctgaagggagtagaaataaatgcatttggtcaatccatcatttttattcagaagtcatacaatttttaaatcacccccaaattgatataataaatattattgttgatgttcttattattatttataatatgaaatattttaagttcataatactggagccattctgagaaagttcctaaaatagactactgcggaagcccattattgccatggacctgatatatttacatctataattttaatgaggatgtcataagattaaaatttgtgatggacatttgtgatctctctcaatgatgatctctattatatctacatacattcatttctttattaatagctcatccatgcagaactcaattatccaacaatctcattttattgataacaaatgctagaaaaagaaagtatcagaaatggctttgaaacaacgtttgcattgaatctacaaacatttttctggggatagcccataaaggcattaagcaaaaaaaaaaaaaaaaaaaaaaaaaaaaatttacttctatttcataaccaagtacaacagcttttgaaatttacatttcaaatacacagaacttagcaaacaaaacagaagaaaataagagggagcctgtgaacagacaaggaatgatcaatgaaactctacaataaagaggaagagaggggaaccagatggtagccaaagcaactcacattcctattaggagcttgtaggagaagctgtagatgccccactcaaacctcccagggctctgtcatttttatgttccccggcctggctcttgtctgcataaacctctctttgcctcagagctttcttttgtagttcaagcctacactgcaacccaggtgcatgacaggttaaaagtgccagagaattaatgccaccaggaagcagcctgcaatgaatgactggcagaattgatgtgtaaatatcccagcttccttgccccttggttaagtctaaagtatgtgttgtgcactggtgaccagaggtccctggaaggatgaagctccagttgtcactgtggtaatctgcctgctttcttggctgccttcctttactgtctcatttctctactctactataagcatgatgttttcccgaatcagctcccacctaaaccacaaatttgaactaaaatttgtaacttaatttggaagagcccaaaataagaaagaactatttagatttggagaacaattacgtattcctcaacaggacattattatatgtacaaaaagtgaaatatttaattttcaggatgacccacattcagtgaggaaacattcagttacattcaatatattctatttaagaacataaggatcatgtatatgtttaagaagacttctacttaatctagctaatacattatggttccagtgtttgacctttacttatatggaaatttaaaccaccctgaatgattcatctgattaaaattctggatatataagagctcttgggttaaggaaaacacgtgtgaatgttaaggtactttaaggaaataggagattattaactaaattgtatacaacaaaaatcctccataagcctctgtaaattcaagagaatatactagggagggtattaaataagttagttatagttactactcttttggaagatagaatattctaaaatatttaaaaagttaacacatttatgaaataaatgcttgcataaaatactatgtgtatatctgtgtgtgctttctcccagcttcccctggaaattagtttactagaatatccttattgctaacacatttccacgttctcctgactctcttgggatcatctgaactatggggctaacttactctcactctactacaaaaatttaactaacaggaataatcgtaaagcaaacattttaagtgtatcctgaataaaaaattgtctccatgcttctccattctgctttctcatcttctaacaaaaactaccagaagagactaaggactaaattttgggacaggtgaaggagagagttgaatctctctgccaggagaatggaagaaacatatctgttatcgttgttgtttctagaggaatggaaccaaactaaggggtttgggatagaggagaaaaggtttggaaaaggaataagagagaggagccaatagacttgaaaaatagcttgtatcgaattgcattttacagtgattgtgctgcactcatctccaatgctacaataaaatcaaatgcccacaaaaagaccacaaattaatgagtgatttatttttaaataaataaaataaatagggatcaaaagcagaaacttttttttttttctaatttctgtcaacaacagaatcaatgccaggacagggataaaggtggaaaatgcaaagccaaaaacaataatttagtggaaacaggaagttaaagccagaagtaaccttaaggttctaagtccttggaaattcccttacatacagagaaagccattggatttttgtatatggagggaatactggttcatcccagtctgacccaaaagttatgcgggagaatagttaagttccagagagatgtagctaatgtctgagtatctacttagtggccacagacattgaaaatcttgaaaatgcccaaatcttgaacttgagcacttcagttttagccacaagagtgaagaggtagaccagcagctttcctaaggcctcagttgatgggccttgccttcagtccttcataacctcaggcagcatcatcctctgtgcccaacgtgacctctgctctattctgtgcttcacaagcttaatggacttactttgtagtagaccactcattcttctacagtcttgattgtatggaaagagggaaactacagtagtttttttctgtaacaattgtctgctgttattttctgtacatttctctggcattcaccctgaattcattttctggtcatgcattaacttacattctcccgtggggtctcactttccatttagtcctcctgttcctagacttgatgatgtttatctgtgttgtctggtatcctactagtgacaggtcctgtttatcagtttgctaattatcacacagctcagccacagccttgtgaaataaacatactagttaagtatggtggtatgttaaggagtaaaagtaaagtctgtgagttgcatacttagaaaccgtgacaggaatttatcgcttcattctcattgacatttatgttgtggtagatgaaaggacagtctgacaagaagagagcacgtgtttgggaatcagatattcatacacttgaattttatttttaccccttactaactaatagctatttaacggccatgagccttaattcccttgtgaagtcaggatggtaatacttgactcatgtgtgcagttataagtaaaaggaaagcaccctctacatgataactttcacatgataggggtatggataaattatgcttgcaatagcatagtcataataatacttttaaattagtgactcacttccaagaatggagtataggaaagtgaaaattgtaaaattataatgaagaaacctggcagaaacctctttaaccaagtttcattctgttttctacttctgtgttagaatgctggagactgtgtaatttatagaaaaaaagaaatatatttcttacagttcaggaggatagggagttcaaggtggaggggctgcctctagggagggctttttactgtgtgatgcagaggctatcacatgatgagagggcaagagcatgccagctcaggtctctctttatcttcttgtaaagccacaagttccaccatggggcctctaccctgatgaccttatctcatcttaattacctcccaaaagccccacctccaaatgctatcaacatatgaatttggagattaaatttcaaacaaatgaaatttagggaacacagaaacacattcacacaatggcaccaagttatcaaggtgaacatcaccagtgataagtcatgtggctctactctacttatgtgggtgtgataggaagggcacttcacctcgttgtttttcccccaaatttatatcctcagtccaatcacaaaaaaacaccagacaaattcaaattcaggaatattctataaaatacttgatcaggaatcttcaaaaagcatgtaggtcatgaaaaacaaggaaagatgggaaactgtcacagatcagaggagacagcaagtaaatgcaacctgggaccctggattagatcttagaacagcaaaaaggatactagtaaaaactgatgaaattcaaataaaatctgtagtttagtaaacggtattgtactcacgttaatttctttgttttaacaaatgtcttatggttatctaagatggtaacatggaaaactgggtgaaaggtatatgggaacttatactatcttgaaaacttttctgaaaatctgaaattattccaaacaaaaagtttgttgttgttgttgttgttgttgttgtttaaactgaaaaggaaaaacatttggtaggtaacagatcagtggttgccaggggttagggtacggggagcataagggagattttaggggtgatgaggctcttctacatcttgcttgtgattatagttatttgaatctataaatgtgttaaaatgaggacaccaaaaatgtcaattttaccatatgccaatttgtttaaaataaaacaaaataaaagaaacaaatgtcaatgggaagcataagtactttttatagtaaataaggcaaaaggggaaaatgttggccgggcacggtggctcatgtctgtaatcccagcaccttgggagactgaggcgggtggatcacctgaggtcaggagttcgagaccagcctggccaacatgttgaaaccgcatccctactaaaaatacaaaaaaaaaaaaaaaaaaaaatagccaggaattgtggtgggtgcctgtaatcccagctactcagaaggctgaggcaggagaatcacttgaacccgggaagcggaggttgcagtgagccgagatctcaccactgcactccagcctgggcaacaatagtgaaactccatctcaaaaaaaaaaaaaaaaaaaaggttgggtgggaaagtttatagacagtgtaaaattgctgccttctttcttacatataacactgtcatcatcaaattgaagaaaccttattaaatatatttattctttcctttaacaaatattcattgaatcctaatggtgtgtcaagtactgtgctaagccttgccagtagacaagaacttgatgtgttctagatgttaaaagaagcccttattccaagataggccagcatatactattaaaaagttattgcatgaagtcagggtgtagacatatcgggggttaaacagacatgaaatatttacatgatatttcaagataatgttggtactctattaaacaaaatgaattatgatgacataagttaagaggagacttaagacagccttggatgtataaagaatttttgtgaaggaggtacagagaacttgcagagttttcttgtctgtaatgtaagactattatatttagaaaaggaacattgaaatttaaacaatgtaatgtttttagttcaaaagtatattaaaatacccaacactaatgagcatttagcataagtaaaacactattgtaaggactttacatatgttaacctacatgattctcgtaagaattttagaagatagatactattatttcccctgttttatagataaagaaactgacaccaagcatgtaatgtgcctaagatcatacagccagtaagtaagaaagccagaatttgagtccaggtatttgactccaaagcacacactccaccatactaaatacatggcatctatagtgatggttatttaactttcccagctggaaatagcattaagtgtttcaaatatccaaggaaccgtgtttttttttttttttttttttttttctgattgaaaatacaactggttataacatttgtttttttctggaagcagatagcctttgccatgccttccagttggcaccttgccccttgctaatatgcatggatgggtgccttttgctttgcagcctgccagtagaacgtgaccttggcagcccggtgtgccagccaagattccagaagagcgaaagtagctcttaacttcttgaagaaactctttgaatcaccaactatgccttgccatatctgtccacatggtactagtcctttcacaaggggctcccaagctaatgactctaattggggctcaactgtctctctaatacattctttccttaattttatgtttttctctggttggaatttcctaatgtctaaaatattccattctgtgttactcagcaacgatcttatttgcttgcaagcattgtggtgacaaacataataattaattatgtggaattttgtttagaaatatttttgttggaacagaaacaggaattctatatctgtacagtgactgaaatacaagggccctctctaaatgaattatgtgtttaaatgttcagattttatagtctatttaatcctgtaaatcttaataataaatttgatggcaagcagactgtgagtggaattttagataacaacatatgttcatagtgattcatgaaaatgtaatcctttatggtaaatctgtattatttataccaaatctttctctctggcctagaccgcttttttaaattccagacttcctacagatatatccatttagatcagggtttttgagatttgatgctgttaacattttggactggccagttctttgttgtggggtgccatccttcccattgcaggatgtttagcagcgtctctggcctctacgccctagatgccagtagcacaacactccactctgtggtgacaatcaaaaatgtcttcagaagttgccataagaccccggggcaataaaatcatctctattcacgaaccactgatctcgatgttctataggcttatgaaaaatgacatatacaaaattaaactcattttccccttagagcttctcctacagaggggttaggagcatatctgaagcaaactctgcctccctgctttgatagctgtggaacttgatcaaattaccaacttctctatacctcaatttcctcatctctaatataaataccttaataaaacctccttcatatgactgttaggaggattgaatgaactaatatgtataaaacatttaaagcagttcctggcacataggatgcctaagttaatatttgaataatcaattaatactattaaatgttagcaatagtcctacagtacaggaaaattctaagatttttctttgtatagaatatgtgcagatacttttttaaaaagattaataagtgacagtaaatacatgcaacaaagctcaacatcattaataatcaagaaaacacaaaataacatcatgatatataaatctattaaatttggaaatatttttaaaaatacttcatattaataagattgtggcaaaaggccctgtactgtactgatgggagaatatgtgtctgttttctttctggaggatcagttaccactatgtatcagagcattaaaatatttatagtctttcacagagttaatctagctctagaaatttatcctaagtgtgtaatatgttaaaaattaatgaagtatattaattactgttatttataatggcaaaattagaagctacctaaaatctcaataacgggaatgaagaaatagctcatggtatatttatgtcatgcaatatgtagatatcacattttacaaataataaattaggagaatgctccgactatggtaattcttagttcaaaatgcctccatcactttcaagataataatagaaatatttaagtgtgcattatcatgcacacataaacatacaccttttaaagttattttttgacagaccctgtgtatttatcgagtcattttttctctctaggtttccttccaaattctctacccacacaccttaagagattctgatacatcataaatagagggacatacatctttacatgaaaacgacatggaagattttctgagggacatgtgaatggtgaatttgcatgatgtggagacccaaaatggctgaggactgctgctcagtgccccagctctgttcactcgcctagagtttcctcaacaagccctgctgcttctgtcttctgagctctgacccaccaagccatttcctctacttggagtgctttccttccctttctgcttttcccttctcaaaaccaagctaaaacattgcctgctctatgaaacttatcctatcaccctgttcagatgcacatgcctttcttctctacttttgtgacaccacatgcagatctgttcatcatattttctggtattcatttgtttaaaaatatgaattgagataccactaaatgccagatgctatattaagtgctaactacagtcttggtgaacaaaaaggtaaaattttcctgctctcgtggggcctgcattcttatggaggagatggaatatattttttaaaacataaaatctaaatttattttgaggtgattttgatcagcacctcaaagaagcaagagggtgaacagcagtaatatctgagggacaagcattctaattatagggaacagcatatttaaaagtcctggactcgttcagtgtattttaggaaaaaaaaaaaaaaaagaaaagtggcttacaaggttgagactagcagaagtgcagcaagaaatgtgaccaggaagacaccaagatgctgtatgataaagtcctgaggccactgtaagatctttggattttaatttaagtgtgtagaataacatgatcttatttacgtagtaaaatactaagaggcaaccttctggctgctctgtaagaagggattgtaggacccaaagtgaaagcaggatggtcagctagaggctgtcatggtgatttagctaattgatgttgctggcttggatctaggtgacaacactggaggtggggagaagttatcagatttgaaggatattttgaaggtagagttgataaagatctcataggtttggtataggttaaagaaagctaagcctcaaggacaactctttaagttttgggcttcaataattggatggattttggtggcactttggtgaatgctgagtgaaggacatgtttaagaatgaaaacatgttaatagattctggctgtattattaggtgtgagatgccaaccaggcatcaatgtggagatgttgaagggacagtgtttaggaaaagggtcagaacagagatatgtatttgggcatcatcctcatatagatagtacttaaagttatgatgctgacatgcctaccagggctgtgagcatagtctgtgaagatacaagttctgaggtctgaactctgggacactccaccatttagggagcagaaagagagtctaacaacaacaacaaagatgagtatgagtggttaatgaattaagagaacaggaggatgtggactattagaaactaaggaaagacagtatttcaggaagggggagctgatcatctaggtcaaatacataaagaatttaccactggatttgcattgtggaggtcattgccaaatggctacctttgtcagagccatgatgctattccttggcaaatgttgacttacttatctgtttcttccaggaaacctgtgaacctcacataggagtgattttgccctccaggaaacctttggcgatatctggagacatttttggttgtcaaaactgagcggtggtggagtgatgctactggcatctaatggatggaggcacaggatgctgctgaacatcctgcaatgcacagagcagctcccccacaacaaaataatgatctggctccaaacgtcaatggttccaaagttgagaaatcctgcactaaacgtatggttcccaaagtgtgtgcttagacaccccagggtggacataggagtgccgtaggacattttaaagtgtgaatggaaacacagtggcatctgtcaagcactaaatgaactactaactcaagatagttcacagtttcaacattagctttctttttttttttttaaataatgtctctttgtaaaacttggttttggaagttgctgtgataagaatcaaatacttggtgaatatcactgtggaataagaagtgagaatggcagtttccaatctgacttcaaggtttgtgaagttgggtagtgaccagaagttgttgagtttttaggacgtaaatagttattaaattgtttggacttgacaactcaagaaactcaattattaggtatatcttttggcctagggggtgtagtaaaaaattatggatatgccacgggcaccataaagcagaaggcttgaaactgctgggcttgactttaagttccttgggaataggcattgtgtattagtactttatatctgcagcacccaaaacagtgcctgctacaagtgtgaggtgcgagaatgccaaacagatatccataaggagattgagggaaatttaataaatttaagaaataaaatggcaggtatgaaatgaatgaaagggcacatgtgcactgtagtgtcaagagaattatatgttaagtggcaaaattcgacctactggttcactatgcactacaacatccctaaatacctccctacttatataggataaaataagagaggggaaaagaataaagcttgactttcttattctttggcctgtgaatctctagactaaaatttcttgagtttggtgcaagtttacttcctcagattacattattttttcccaatacaaatttctattctcacttatattatgcatattgacaaaactgtgatcttattctgcaggaatatgtgaacgggagtaatttgaatatctcctaaatttttggctgcttttcttcctgccccttttgccaagcactacatgccctagcctaatgattgcatagatgttggaaagagatgttctttttagagttagtgattctattttgtttttgaaaaaaatcttttcagtgtaagaatatgatttcagaatataaacttgtggaaatattcttggtatagtggcaagaagtcagcttttagaatgggatatatagtcccatgcatctcactctcactgggtcacatctggatcaaggcataaggtttctttgactcttagatttgtcacctgtaaactcggaatacgaactctccaagttcttatgaggattagactagttagctgatgacaagtacctatcacagtgcttgacacaaggagatactcaataaattatagcttctccttatatttcaacctgacctatcctgacaccttctttctccttctcattctcttagtcttttgtttgactttaacacctaggatgaagcttatagaacttattaccattttaaaataggcaagttgtttgctttgttggtattttgtgttgtatagtgatggggtggtattttccctattaataatgtagtgcatcaacaaatgtaaatatattcatagaaagttctccagcagggacagagttggagaatcgctgagtcaccagtctcccctcacctgagagtgttcacagtgaaacttctctccgttgtgtgttttgtggccttgcttatttgcaatggtctgtcctgaagaatttgagattagagaccccgtggataatcatattccaaggtcaccagtaaaactaaatttctgtaatagttataacttctactaaatatttttgctagagcagctaaaatgcagtctgcctgtgaaatctggctgacttaccttattcagcctataaaagttatgtttactctacagtgtagtcatttaagtatgtaacagcattagcctaaaaactatacatactttaattaaaaattactttattgcttaaaattgctaatgatcatcttcactgagtcacaaccttttttgctggctgagggtcttgcctcaatgtcgatggctgctgaccaatcagggtggtggttgctgaaggatagggtgactctgacactttctttttttttctttgagacggagtctcgctctgttgcccaggctggagtgcagtggcacgatctccgctcactgcaagctctgcctcccgggttcaggccattctcctgcctcagcctcccgagtagctgggactacaggcacctgcaaccccgcccggctaatcttttgtatttttagtggagacggggtttcaccatgttagccaggacagtcttgatctcctgaccttgtgatctgccctcctcggcctcccaaagtgctgggattacaggcgtgagccaccatgcccggccgactgtggcactttcttaaaataagacaacaatgaagttggctgcatcgattgacttttcctttcatgaaagatttatctacagcaagtaatgctgatgtggtttcatagcatttgacctacactagaacttctttcaaaattgaagtcaatgcttctcaaaccctgcttctgctttatcagctaagtttatgtaatattctgaatcctttgtcatcatttccacagtgttcacagcatcttcaccaggagtagattccatttcaagaaaccccttccttccttccttccttccttccttccttccttccttccttccttcctaccctccctccctccctccctccctctctccctctctccctctctccctttctccctccctctctccctccctccatttgcattcacaattttgtggtttggttcaagaggccttgctctccacctgtcttggctgtcaacatgccttcctaactcagcttaatcatttctagctcttgattgaaagagagatgtgcaactctttctctttcacttgaacacttagaggccattgtagggttattaattgccctaatttcaatattcttgtgtctctgtgaatagggagacctgaggagaggcagagagtcagagactgactgctggtcagtgaagtcggaacaccacacacaacatttacagattaagttcgccgtcttatatgggtgtggttcgtggtgctccaaaacaattacactagtaacatcaaagatcactgattacagattaccctaacagatataataataatgaaaaaaaattgaactattgcaagaattacaaaaatttgatagagacataaagtgagcacatgctgctggaaaaatgacactgacacacttgctcaaagccgagttgccacaaaacatcaatttgtaagaggaaaaatatctacaaagcacaataaagcaaagcaaaataaaatgagatatgtctgtagttgtatctggtatgtaattagctcttggatttattgctttaataagtgtatgtgagtctattggtgtaaccttcactatgtaaaaaaagcaacacttttgtaacacatttatgacaaaggactcatatctaaaatgtataaataactcaacactcaacagtaaaataaacaaccagagcaataaggaaatgggcaaaaatattaaaagactgttcactgaggaggatatacaaatatcaagtaagcacacaaaaatgtaataaatatcagtgggtaaatatatatatctctatgataatagctggaattcaaattataatgtcaaatgctagtgaggatgtggataaattggagcgctcatacattggtattgggaatgtaaaatgatactgctattctggaaaatagtttggctgattctttaaagatataaaaaataggccaggtgtggtggctcatgcctgtaatctcagcactttgggaggccaaggcgggaggatcgcgaggtcaagagatcgagactatcctgaccaatatggtgaaaccccatctctactaaaaatacaaaaattagctgggtgtggtggtgcgtgcctgtagtcccagctactcaggaagctgaggcaggagaatcgcttggacctgggaggtgggggttgcagtgagctgagattgcaccactgcactccagcctggtgacagagcaagactctgtctgaaataaataaataaacaaacaaacaaatttaccatataagccagcaattgcacttctggaaatttgtcctacaaaaattaaaacttatgttcgcacagaatattgtgcacagttgttcactgcagctgttttcatttgaaataactcaaaacaataaacattcacagtgtccctcaatagctgaatagttaaacaaactgtgtggtacatccatgccatggaatactgcattgcaataaaaatgaatgtactgttgatacagacaacagcttggatggacctctagggcattatattgaaggaaaaaaagccaatttcaacagtttacatatggtatgcttcaatttattaacattttaaggatgttaacttcctgattttgatattgtactattattatataagatgtaaccattggggaaaactaggtgaagctttcacaggattcctctttgtactacttttgcaactctccaagaatctataattatttcaaaataaaaaggtggttttttttttttggtaaagtcatattttatgcacacgcacacccacacccacacatacacacagtttcttatggggaaatgttattttgaagtaaattgggaatgtaggcatttcatttattctttccaaaatcatttgtttctacttttgcaggattttttttcttcttcctcctctttctctcccttctccctagttcttttttttttgtaggatactgagatagcttacttttcttgcttaggaatgccttcattttttggaaaggcattctttattttttttttaccattttcaactcaattttagttatttaattttcctgtcattataatttggatatataacttctttgagaagtgcagatcatttcatagctatctcattctttataactcaatctttttgttttttaacagattagaacctaaagcagagaaagttagtgatagaaagcatgaagtagagtaacaaaactgaaaacagccagttgccctaccaacctgttctgctctattcttctattttttactgtactatattcgatcccatttttttcgttccattctatgttatgatttcccaacctatatgtattccattcatcctgttctgttccattctatgcaataaatatttaatgagtgtttagtatgtggcaggtgttagtctatgtggcttggcatgtaccagtcaacacaacagataaaaaaattgctgctcttctaaagcttacattacaagaggaggagacagaaacaaaacagacttaattcgtaagtaaattttagaagttagtgagtgctatggaataaagaaagagttaagtaggtgggggatatcaggtgggaatggagggaaagttacaattttcaaacagggtaaggtgtgagaaactgtaaggaattttgccataaattgatctgagcgatgcattttctgatcactaagaatagcaaggccaaaggcactaggatgtgagatgcctggaatgtttaagaaacagcagggagatcagagtggctggagtagagtggtgagaggagagtaggtgcaggtgaggtcagataggaaagaaagatctgactacaaagggcttttgaaggtgttggtttttactctgagcaaaatagtcagccatggcagggctttcagcagaagaccacatgatctcaattatagtttaggaccctagcaatcctgttgagaaagacattggcttattctatactcttagctgtgaaggtagagagaattattattcatattattaacaacaaccacatacatcaaaaaaccctcaggatattttgaagatagagtcaaagggatttcctgatgaatttaatacagattgtgagagaatggaaggggtaaaacatgattccaaggatttgggcatgagcatctggaaggttagtgttgccaacaaccaatatggagaagatggcatatggagcaggtttgagggggaatgtcaggagatctttttttagatatggtaactttgatatatcttttagacatacaagtagacattgcttgtaggcaggtgggtatatgagtctggagttcatgaaagagatccagggcagagatacatatctgagagttgccaacacatagtgatatttatcatgagattagatgaggttaccgaggaagtgactataggtggagaagaagaccaagaactaaaccccggggaaccagagttaagaagtcagggaatagacaaggaaccagaaaatgagacaagaagcaactagtgagatagaaaccctgacaatgtgtgtcctctcagccaaaagaagaataagtatcaaaagcgatccaattactaaactgtgtctcttacctcagtgcaaatgtgtatgatgtgattcaatatcttcctgtatccctaattttatttttattctatttttatactggaaaacaggatcattttttgtttgaaatttagcctgctaagaaaaagtagactttgttgttattgttgcttaagtttcaaacagaatcaacattgtttaaaattgttttaagaactagatttggtgttaacagtttttctgtggtgagtctgaatttccttgagccgttatttacagcagaaggtaaccactacacttattctaggaggctggattgaaatgtattttatgtattattatcttaggaaaaagatattaagcatcttatctttattatgatcacatttgttattatcagcatcttctatagatagtactttttgaggctacatgttattgtggacttgtgcatttttaaaagattaagcatttggcttggaattatcaagtaatcctgtgtagtaactgtgattaaaattatacaggaattcatttcaaactgtgacaaatatattgtagcttacactcttattgaatttgttcatatattttatcaagaatgtcaagtatttttacattaggtttatgtaggtttataggtggaaatataaattattagtaatgcaaattatgatcttgaaaaagtagctagattttcaggttttccttttttttgagcctgcagactatttggaaattaatttgcatttttttggtgtgtatttatattgtcttttgcttatattctgcattacaggattctgagtttccacttaatgagtaggctttacagtacccacaaattactgcaacaaagttaaaaaaaaaagcactagaagcctaatgaaatggactgctgagaacagagctgaataaacacaagcttccctttttgcagtgactgttccaaactaagcagaagctgcttctttatttcagggaaggaaaaataatgacccggttttctttatttttctggtgagcaatttaactgctacctccatttggcatattctcccacttcttttactggaatgggctataactgtaggtatggcattctttgccacaatgtatattttccttactgcagtgtatattttgagccatatttaccaacacagatatttactttttctctgagatgtggtctagaagcaattgttcagagagaaattcaacactgactctagaggtaaacctgtacccggcatttcagtgtgtatgtgtgtttgtagaattatcatcaaagagagaagattattcttccagatggcatttaccttaataaaaactgctaatatgcacaagcttgaaaaccatttctaatccaagtgtactggcagcgtgttattttcaggagtagttgcattaactctttgaaccttttaaaaaaattatcttctacttttgaactaggtcttttgaaagataatagctatcctaagtaagttatcctttgagtactgtgcgtgtgcacctttgtgtgtatttgtgctgtgcgtaaaccattgtgtattttggcatggcccaagtcagcaggaaggctccagggctgaggctgctttcatcctctgatacaccctcacaaccttcctgttttacgataattctgaaacctaacgctcctgctacttttaactcagaactgtgtttatttgcctgtggcctgttttattgtaaaataaaaaccttaagaaccctatgtttttagggtgcttttcccccctcaagaacactgtggttgtcttaaagcctaaatgactgtgttttaatgatgtgtaaagattcagtaaaaaataaatcatggcaattttgttttaagaagaaacttttaaaggcaatacgtgctgcagacttcaaaaagtctaatcaaacaattaagaacaaacagtacttgtgtgaacttatcattttattctgcacttttcataacatattaggtgttaagcttcgaaagattctgctttaattccgggtaactattggtaggggatttaagtcacaattatttaaacataagtttttcacagatcttgaatgtctctgggaattttctccccgaggcaaataatagagggaattaaagctgatttgttttctttgccaattgaaattatgagataggtggctgccactgattttatcttacctacgagcatcctacagccccttatgttctggtaatgcccctgatggtgatgcatagtaaatagtggagtaaattagaagagagttataggtgtgatgggagtaatggataagttaaatgccgtctttatcctcaagggacttacagtctggctcagtatttcttatgaagggagggtgggacactattggcattttaggtagggcagttcttttcttgtatggaaatgttccacacattgtaggaagttaagtttctctggctcctgcctagtaattattagtagcaccgttagttactgtgacagtaaaaaataagtccatatatttatcagatgtcctctagagaaggtattaattctaatccttcttccttagaacagttggaagatctgaaatatacactatatgcataagaagtgattatagaactgtattgtctatattgtcgaaactatgttaaaggaatgatgcataccataaaagcgaagaaaagacaggaaaaaaaaaggctggttagttgcctctgtgtacaccaactggtattacagatcactttttttttttttttttttttttttttgagacggagtctctgtcatcacccaggctggcgtgcagtggcgcgatctcggctcactgcaagctccacctcctgggttcacgccattctcctgcctcagcctccggagtagctgggactacaggcgcccgccaccacgcccggctaattttttgtatttttggtagagacggggtttcaccgtgttagccaggatggtctctatctcctaaccttgtgatccacctgcctcggcctcccaaagtgctgggattacaggcgtgagccaccgcgcccagcccagatcactcttgaagatcatgctgattcttctgctgtgactatcctcttctgtctccctccttcttttttttctgccctggataactcctacttaaccatcaagataaactaaattgttataccttccaagaagccctcatgagctttctctcttcttagactgggtgggatgactatgaacctggttcttacaaatcattgggtgcatctctgtcactgtcttctagaattctattgacatcatctgttaagggtcctttctatcttctcagtagcttctatgtgtatattgcaggcaggaactatatactacatctttcttacctagttaaattctatgtgtgaagtgcatattcaattaactgacctgaacttggcagaaacatataaaattgtgtagttgtatagttgatgaaaacatataaaatgtagtttcattattttttgacatcaaattaaaattctgttcaaaagtctcctttaatataactttgctcatttaaaaaagattcttatgccccactgttggaaatataatttggtacaatgcttttggaaagacatttggcagtaggtatcaagagatttacaagttcatggtatttgattcattaattccatttctgggaacctctcctaaggaaacaattctaattatagaaaaagcctgatactcaaaagtctgcatttcaaaactgttactaacagcaaaaaattccgaagtcttcaagaagtctggggaatgggagcttggttaattattgacaatccaattctaatggataattttgggacaattgtggggaattgtgtgtgaatatgatctggcttttagatgtgatgaaattattctgaaatagatggagattgttgaccccccaaaataatatagctacaatacaatatgactatattacctcattttagtatacacacggagacagacacaaacacacagatgtgtgtatatgaaaaagatccaagaggatatactggatcttagcaatgctaacatctgggtattaggaattggtgttgatattttctgtattttattatttcctaatttctacaatacccatttacagatgtaataataaacgatatttttaaaaaacaaggaatcgaaaataatttaaatgttcattagtaacatatggctaaattaattattgtaggtctgtattctaagttatttcattatattcaaagacaatatgagaaatttttataacatggcaaaatagttgtattgtagtattcagtgaaaagagcaagatgaaaacctttttacataggttggtctacactccaaaagtagatctcacagtgatttttttctacatggtaaaatcttgggattttctttttattttcttgaattatttttctttagtaaatatatctttttaattggaaaaataaatatatcatcaaaaattctgttaaaaatgttcatgcttcaaaagtttcaggttattgttggaggcagttcaaaaatgttatagctgtgaatcatggctgtatttaaatacaggtagcacttcgtgttagaaatatgtgttgggaggggtttatattgtgtgtttatgtaaagatagggtaagatttcacaaacttcttatagacaaaaacagttacaaagatttgtgtcattttagcataaaggtgagttccttaatattactttttattaaatcatttattcattccttcattcaataattatccattgagcaagggcttgggtgcccaagattcagaaataagaaatgtagtaggaaacaacacctaaaattgacttttctctcaccttttgggcaaaaattggaagacagttaaattcttttacgatagcagtatcctatgtgatcaaaaattcaaagcgtctttactatctaaataatgtctattgaattttcagatgttctctcagctctttaattaagttcactaatttctgtctcaatccagtgttgaagtcagcagccaaatgccacatatggaaaaatgttcctctggaagtaaattgaatattttaaaaattactgtcacttatcttaatatttaactcaataaaacttctgtttctcagtgtttccccacacattttcatgtgtctgttaaattgttggtaatgctgcatacataattccttggaaaactaaatggattctctatcatttagaagagttttgggggtaatgtggtaaatcattttttgagttgggtaaataattcttttgagtaattaagtaaatctaatgagtgctgtttaattgcttattggtttattcagtcttttatttgcttcctgtatggcaagttcagaaacctattaatattgctatttattgagagggcttcttaatatcttttaatgagaaaaatacctggtgacagtttattagggaattcagtagattcaagaggaatttttaaatgatctcatttgtattttagctataagttaggagacaaggttctgtgctcagattcccagctactgcaggaattgtatgattgtggttatttttaaagccagaagacgctcttttggagttctgttatttcaacaatctagatctattctccatgtgatattgacttaaaatttaaaaagcagatgtaggtcaaaggagattctgcaaacacttttgctgttttatcctggggctttgacaactttaaagcaatgatgagtttttttttttttttttatatctaaccttaatcctcctggtatactttaaagtcacctctccctaagttttctttattacaaatgtaaataaaaatgggattgttatgtgtgttctttattttagttatgttatctgtttcatctataatatatagagatataaacataatatttcatgaaagatagactttatggagaatacacagaatctgttactagggatttctactagtagtagtagtagaaggggtgagaaaagggaatttttgacctttttttctcttgtatggttaaaatgtcttgccatgaacattgcaaattatatattataaattacttttataatttaaaaatatattttatattgtaaaatattaacaattataatgatattaagtattataaattatttttataatttaaaacaaaaatgaaatattatttatatacaaattgttggtttgtattaggcttttggcatattaggggcttaataaatatttaattgaatttcagcatgtactaacatatatttttctttttacaagtgagcctactacctgctgaacttgaaagaatctagcatttaaaagttctttaacaatataggaaacctagaataaacaagcataaagactttaaacatttttaaaagctgtttaaagaatgttcttatattggttagcctttgggccccaaatacagaaagcatttattttcattttaaaaagggcccccaaacaagacagggctaataaaccagttataggatacagctttttttccatttagaactttatgcaatctgtcatcttctctgatccatcattattaatggttagtcttctcatgttttacatactttattcttagaatcctcagaaaacacactcatttttcctgctactaaaataaataaacattgcaatttattcctaaatatagtgtatttccggttattggtgtttctttcataggccattggtaagtgaaggaactacagagaaataaggggtaagaggaaataaaaatgctatctcaaggtctttgttctgccaaggtcatctaaaagctacacagcagggttcatttcaagactacatttcagggttagctcactaaatgtatccaccatactctacagatggggaaactcaggttgtgcttagcctaacatacttggttctgataatgcttggttctgataatgccaagatgataaatagatttagtccctctattgtaacatttgtattgaatatatgggttttgtaggataccaccagaaaaccaactttaattgctttctcttctacccattcaaactagcactgaaagagaagtctgactcactgaccaccacttgagcacgaacttttctggcaacattcagataattaaaagtcatcaaagcactttagcctcaaatggtctcgattcagtaattatcaatgtaatgacgttttcttcacagtaaaggtttctcagattcactagctcaaccagctgcatggatacacctgaaacagaaaagaatggcatggtcagctttgctgtttgccccagcttttgtgttccatagctgctttgccagcttgttaagagtggtgacattgggaagtgaggggaacaggtaaggcagggaaatgccttccatgttgggtgaggtgacatccctgttttggactgatgattaaagctgcctctttttctggtggatgcttacccagggttcactcatctacagttccctgaactaagtgaagcatcccccgactgacaagttacaacttgttcttcacactttggacattagtctgtacacctccagaatattccttctgaattccaactaggtgtccttcatgggcagattctaagacagcaaagcccaatagtcttgttctccctctctcccggcccagatctgacccacacaatacatacacacaccttcgtcctgctgattaggtgggtcatctttgcccaagtgtgttcaatcaccttcttatccttgatgtttatactttagatttctcaggcttgagtgagaaaccaatcgatcgtatctccaaaacttctggaaacatatcaatctctctaaatgaattctctgaagtcctttttactaatgttaaggtgagggacaagcaagcctgaaccatccctgaggaggagggggtagggacatggaagatactgacaactctctctcaagacattccccatctcttttttccatctctttgaccggttttactgcagcccttttatacgttggagtttaaggagctaaggcccctacactggtgttcagttattcccttttcagcctgcataggtggtctggaatgtgggagtagttgacacctactttcctggggtctcagccaaatgaaaataattatttagtaacagctttgggaatataactttttcacccttttctgtggtctctgagatactttttaatcctcaaatattatattctaaggtcttttaaaaatgtctgtatgttagaagcagtaatgctggctataccacctaaatataagtcttacactaaatgtgagtcaaattgacccaaatcctaaagtcttcctatatttgttttgattactcattcacttgaatagataatacatgacatgatatgaaagctaagataagcaaaagactatataatgaaaagtcttttcttctgttgtaaatcttagtcatgtttctctttccaagaggcaatttttttattatttttaagattcttatttcaaacatttctggagatctcaagattcatgtggagaatataaaaaataattgggctcagactgatctgacataatattaggtatatgttatctgtcagcagagagatattgagcatggaccataactgggctcactcctgctattctacctgtgagttagaaataatactaaagacctctaggagttgtgagaattaactgagaaaaatggatttaaaggaaatagtagtttctgttgtagaatattcactctatacatattaatttcttaaagtcccaacctctttgtgatgtcgtattagtttctgcttactccccaccctcaacactaaccattgtgctaccaacatcccctgtatgcctctgtgacagctgcttggtttcctgcatatactcacttccaaaaccttgttgtgtaaagtgtgcctgttgtgccccgtgctcatctctgacatagcacttcttcactacagtgtagtggaatatgcgtttttctcttcaacttagtgccttgttttgtcactcagcacagtgattggcacctagtaaacagtatgtatttgttggacgagtgagtgcacaaattaagcaccctcattaaaggcctgttctgttttgatagagggaacgtggacagaggtgaagcattttgatgtggggaattgtggggaccatagagctagctcccctggaatcagagagggagcattagcttggtagagagagagaatatgttaaggaaaaggcaaggggcaaagtcagaaggccatgaaggtcagataacacatctggaagtttgcttggacctcaccttgtcccgtgctctcctcctggcattaggaaatgactatcttattaagacactggcgcctttgaaggataccaccgatattcttacatactgtatcagtcagccccagaaagcctttggtgtcaggggataaaaagaaacaacaacaaaaaaatgaatcatttttctctcactttcaagtgattagaatagaagaaatagaaagatccattgccttgattaaaagaagtcagttatttgtggtggcattttaagtggatgctttcgcatgtgcttctccaaaagaagctggtaatagtatgtattgaatttaaatgtaacctgaacggctagagtgagcacactaatatggcattggcaacttcactgagcatactttaaaaattctaaaggaatatgccaattccccagagattatcttcatttctgaatgaagaaatattttgttctgtatattaaccttttgttatgcctagagctcagtatatctaaacaatttaattagattattttaactgctttattgagataacatgaaattcacccatttaaaatgtacaattgagtatattttagtctattcacatggttgtgcaaccatcaccacaatctaacatagaatactttttaccctttaaaagaaaccccagacccattagcatcaattcccattctcttttccatactaccagccataattaatcactaatctatttttttatctctataaatgtgcccattttttggacatttgatataaatgaaacgataccaaatatgtggtcgcttctgactgccttcctttactcagcatggtttcaaggtttacccatattgtagcatgtaactcagtacttgtttttattattgctgaataatactccattgtttcgatataccacattttatttatcagtgaatcagcagatgtgtatttggattgtttcgccttttggctactatgaagaatactgctaagagcattcatgtacaagttttcgtgtggatgtctttttgtttgcatatatctagcagtggagttttgctggctcgtaagtacttgccaacacttcttataatacatctttttgattatagccattctagtgcatgtgaagtggtatcttatttcagttttgatttgcattgccctgaagactaaaaatgttgagtgattttcaaggacttattggctatttgtatatcttctctggagaaatgtcttttcaagttctttgtctgttttttaattgggtcatttttattttgattattgagtcgtaagattttattttatacactctgagtattaaagatatatagtttgcaataattttcttccattctgtggattgatggtattattttcagcaacaattttaattttgatgtagtccaatttatgtgtttttctcttattgcttctgcttctgattttgttacctaataaaccatagcttaatccaaagtcacaaagatttactcacgtattttcttgtagttttaactcttaacattttaatacgtgatccattttgaggttttctgtgtgtatgtgattagttgtcccagcaccatttgttgaaaaactgttattttccccattgaaataacattcttgtctaaaattgattaaccataaatgtaatggtttctttctggattctaatttctataccattcatctgtacatctgtccttctgccagtacttctttgttgtattattataactttgtaataagttttgagattggaaagtgtgagtcctctatattgttcttccattctaaggttattttagctatactgggtctcttccatttccatattaactttaagattagtatgtcaattgccaggaaaaaagatggaattttggtagggatttcatggaatttgtggatgaatttgggtcatattgctatcttaataatattaaatatttaacctatgaaaatgaaatgtttttcattcgtttagatctcctttaatttccttccatacagtgttgtaatttcgatgtacaaggtttgcacttttgttaaatttatgcccaacaattttgttcttcttgatgtaggtcatgttttattgattagttatttattttggttgtatttactgatcaaattttccaagatttcataaatatattatgatatattttgacagaaaacttttgtgatggctaagaaaggtttattccatttatgtgctcccatttttgctctcaaatgatgttgcccactgactttaaaattaatttcaaaaagttcaatgtggccgtaatagtgctattataatctcagtatatcagtgatttttaaaaacggatttctacttgttttatacaattggtcttcaaatcctgctattataccttgaaaatgtctctcaaagtcatctttttttttccatcctgtgttaagcatttgaaatataaaatatataagcctcctccaaaaatatataagctccagttattcaatggttatgtttttgttatcttcttttgttgttattgttagcttattttagttatttccccattttccatcccctaatatcttttactcagaaaattttcttataacccctacaggcagaattaatttttcctgtttctgtgattacacaatgtatttaaggtgtttagcacaatattcgttatagagaatagtctcaaaacatggcacctgtcaccatctctagttatctattcaaatcatcagtatttgcccatatcatactctatatctttggtatgttttcttgccatcaattccctcagaaccacccaaccccccccatgaacttagattatttttttttattatactttaagttctagggtacatgtgcacaacatgcaggtttgttacataggtatacatgtaccatgttgatttgctgcttttttttttttttttgagacggattcttgctgtgtctccaggctggagtgcaatgccacaatcttggctgactgcaaccctgctgtcctaggttcaagcaattctcctgccttagcctccaaaatagctgggactacaggtgtgtgccaccacgcccagctaattgtttgtatttttagtagagacaggatttcaccatgttggccaggatggtctcgagctcctgacctcatgatccgcccgccccggcctcccaaagtgctgggattacaggtgtgagccaccgcactcggccagattgtaaattttttgacaacaatgactattctcctcatctttctatgttcaaggcctgcatagtttagaaacaaggaaacagtacagttgcaaccatacaattgaaaaaaaaaaattgtccatggctataaattaattaatctgtcctgattttatgtctgtcaaattataggtagtactaacccagtaagagctttattgataaataaatgagaaattacagttttatcaagtgtgaggtaatccctttttttggggcttgcttatttctattaagcttccaagtattttttaaaagacaatttgtattcctggctttattttacagtttggttttatctattctatttgcatactgagaggaagctggtatatagcagtctaagctaaatgaaaaataagtgcgcaattctaatattcaaaaacaggatagaagatgtccatttttatttttttattctaaataggaataatatgcactataatgtttatatttcttccaagtatcttgtaccacatgcttatgattgacattgggcctctatacctattccttttcgttaagagactacttttgtattaacattttaccattagattttattgaaacactattcaaagtcctcaaaatttcaattttatacctttttatttttctgtaagatgaagcaatgtctttagaatgttattttaagctcatctttgggcttccactgtttcctctacttgcccttattttaaactggaaaatccatgaatgtaatgaccacatcttaggctctttcatatttcaaatgcctaagccagcatcaaataaatgtattttatttatttatttatttatttatttatttatttatttatttatttattattttgaggcggagtttcactcttgttgcccaggctggagtgcagtggcacaatttggctcaccgcaacctctgcctcccgggttcaagggattctcctgccttggccttccgagtagcttggattacagccatgcgccaccacacccagctaattttgtatttttagtacagacggggtttctccacgttggtcaggctgatctcaaactgccaacctcaggtggtccgcccgcctcagcctcccaaagtgttgggattacaggcgtgagccactgtgctcagccaaataaatgtattttttaaaaaatatcccatggtttgtttatcatataatgtaaaatcaagaatccaaatatttttcaaagggtagagaatttctgtgagtaattttttcctcagcatcttaatatccaaactctacttgctcacaagattacttaatcagcatcatatcagagacagcttgctgtgtttaccattgttagttgggccagcatatgtccaaaacagttggaatgagaaaaacagccttgacttgaagccaaattagagagggaggaggagaagagttctttagctgttgaacaggactacatattttggacagtgtagggtacttctgtagaaaaaaagaaaaaaaagggtggggaattctttcagccaaaaaacaaaggtgcattttgaaatatctaaatgcactgaaataataaaagcaaattggtgatgttgttttaattttatttatataagcctttgcaagtaatgaaatctttttatgttaaccaaaaaaagaaagaaagaaagaaaagtattctaagatatttataatgtggataatttttttttttttcagttttaccctggcaactttaattggcttagtggtttctaattctgggcaattttctgtttctttattaagcaatgtgggagctgttgaataaccatcacatttcataggatcagaataatatttctgatttttctcaaactgggtattatattactgtatagtaaaaactttttaagtgaggaaaatgtctattcttgttttgctaagtaacattacaaaaagtagatatttttgtgcattccacccccttaagaagcaactattgtagaaagtggtgttttcattgagagagaaaatggaaagtaatattttgctatttattatggaaagttagaggagaggtttccaaataccacaatcaaggaataaaacaattttgaccacaactgaattttatatatcaggcaaagcctgtcctagggtagtttttaattagataaagctttcttcagagttcctgctttcaattctctatcatttcttatctggtagggatcccgcttgcttcctagtacctctccctttctttacatcagaatctattatgtatggtggttattgatttacccaaagaagtcaatgaaggccaacagcagttgccttttgcatgagatatactttctgataaagactaaaaaagtaaatcacacacacatacacacaatttttaggtggggagggaatagctttggcagtagaggaagccttgggaatcactgttttacctccctggttttatttgttttatacatgagaaacccaggatccatagacgtggactaatcaagactagaactggagacgcagtgttctttctgccaaattctgtttctttacattgacaaggtattgggcattagcaagcaattgagagtagactgatagagatgttaatttattcattacttgttctttaaaacaactgtatcccatgcttgtgagaatcaagcaagatgacaaaggtttgttaccaacgagtttggtaaagcattttcagaggagtgtagtggatgtagtaggtttgtactctaggacctggaggtgagagaagacagaggaaggatgtaccataccgtatgttcagaatcaaaccttccctcaggtcctgaggttatcaggtcaagtgtgtcgcaaggcctagcttcctctttgctaaagatgagtttttcttaggtggtgccttagtcattcatgcaaatagacatctgcagtgccagccccacctgctctccagacatgcccagtagtttttgaaccttggctttgagtatgtcctgcagcatgccaaatttatctcgaggggaataagcccaagtgaaccgcctacgtaaatctaaccaagacaggcctgatgtggcgggttgaatttctatgttgaactaaggaatcgcatggggttctatggctatacttctcccccctaactgggcaaggcgaggaaacctgaataacaacccctatacaagagcatttaccttagcatagagacaaattgcactgtttgttgttctctcatttcttttgtttaaccatgataatacttacctttttagcttcaagatttataaattccaagcaattcatttaaagcatttttttaaaagcttgaacttaaaattttgtataatgtgttctctagctactgaatattctactggtctaatctaagttatattataaattttgtggaaaataagcagaagccatttgattcagaatgcctttgctaagctctatgattagcaatgtatttcctatgattttgggttatataaatttaaatttgcattaatatctggaacaacatttgggtaaatatttttcccatagtttttaaacaatacctaactaccagaactatcttgcatgaagcacaaaatttctgtagtggtttgactacagatctattactagggtgatagccaaacttgtagtattattattgcagctttgaggtgtataagatgtttctttaaaacctcaaggttttaaaacattcagaataaactatatcaacccacacattaacaaacatttaaatgtcaaataagcagaatatcctttaatttctaaccatccctttgcaaaacccattccaatgttggtttctataaaatatactggggccttgttagtttatacatacaggatatatgtatatgtatatatatatatatatatatatatatgtaagcttagaattatgtagcaactgctgcacagattggaacagtctatgtatgtctttcgctataatttattaaaagaaatttcaattcaataagtatttgttctatttgtagcttattgaagggtatacaatctctgtctcatggaaaaagagataatttaggagaacactcctgaatcttttactatggaatattatacaggatctttcattaggaccattctaaattaatatttaccatattattaaatatgcaagataaaaaacactgaaaaataatattgtatatgtgacaatggcaaagctaactgtaacctgtctagtgctcattattctcgtctgtgaaatggggataatagtaaagctgtgtattcaaagagaaagtccatccaaaagtcatagctagcgctcagcatatgttgctcattttaaagtgccatcattcttatttatatttttgttttccagttgactgcgtattgtgaagagcaagcaacaaagtctaaaattagtatatcaatctagtgaaaatacttagaacttgttttatatggtgttctcctgtcatgttctatttcctaattatgttttattttagatgaaatacactatgataatttttaacctaattcattcaaccattatagcagagaggtagcttggaaatttgtttgtcacagggacatcccaccatgtgagaataaaaattgggccgggcgcagtggctcacacctgtaatcccagaactttgggaggccgaggcgggtggatcacctgaggttgggagttcgagaccagcctgaccaatatagagaaacctcctctctactaaaaatacaaaattagctgggcgtggtggcacatacctgtaataccagctactcaggaggctgaggcaggagaatcgcttgaacccgggaggcgaaagttgcaatgagccgagatcacgccattgcactccagcctgggcaacaagagcaaaattctgtctcaaaaaaataaataaataaataaaataaaataaaatttggctatagattgattctcaggagttcgcaaactttctgttaggggcagataataaatatttgagattttgcagcctgtactatctctgtggcattcaattctgactttttagtgcaaaagcagctatacacagtaagtcaatgaatgagagtggctgtgttccaattaattttatttgtaaacactgaaatttgaatttcatatatttttatgtcacaaaatattttcctttaaaaaattgttttcccaaccattaaaaatgtaacaatcattcttaggttgcaggccataaaaaattaggcaggctggatttgacccatgagccacagtttcctaactcctgttctgcatagttaccttcattataaatattttcaataatttcttatacttttgattgtacaaagaggtatggcttcaaattacagactgatatctcagagctgtgcttaaagtattgagaagcattctgtaatgctgatggttttctcaatattggctaattctataaacagatactatgagttctgccagaaatagaaattctaatgacagtctaattaaatagaagccatggagaagaattattacattttcttatgccaaattataaatgtcttcaattaatgcacagatatttatttatttatgtatatgtaaaaagtggattttctgacagcctcaggctcctctttgtggtagaaccttctgtttctctaattagttgtgccttaatggccagtaattgtcttttataatgcacagggaacctaaaaaaaaactgaaggaaaaaaaatagaccatcacagtctatcttttcaaatcttttctcatgctgtcaaaaaacagctgcctcttactttttgttactactttcttcaattaaaaagtaatctcaaaatttatgaataatacacccaaacctcattaacactgtttacagttaattatgatttagtatctctctctgtctgatataacccaatgggatttagttaatcaagtaccgaagatgacttcattaccaggcagtctttacctgtgaatcagtagattcacagattggagagtacagccatagtgaatttaagaaaaacaaaaacaaaaacaaaaaaaaatgctaattgcctagactcaatagaattttgtatagctaaaagaaaagggtgaaatattaaatttggaattcttaagtacagaattgttccttaaaaagagtgctgaaatacacactttaagaaagatgctttagacttacctgaaaatacacaagtgtgtcaaaatatgaagaaatatattcaattacacatatctctgtggaatatattgacaattatgaacaaatgtttttcttcacctttaaaaacaaaaatatgtaatattattttaacaaaaacttttcagtctcatctgtatcaaggcatactccagaatgaaatgtgtagaaataaaatgaaatgcctattttgtagaagtcaaatagaatcagaatggagtggttgagatcatggactctggagctggacggtgtgtgttctaattcctgttgtacctgttagtgggtgtgtgaccttggccaagctcctctgtggcctccattttcctcatttgtaagtaagaatcccaagcacgtctactccataggttactagatattgcaacctcataatgttgtaaagaacaaatgaatgaatatttactttataaagcattcagaacgatgtttgttatacagtaagtgctgtaattagtgttggttccataatttaaattagaataagagaaactcgggagactggccaaaattatgctgttactctttgtgcttacccatgtttgtaaagccaaacttggaatcagtacatttagggaagtcacattttattagaatgcttaggacctcaaaactcacctattttaaaactcacatatccaaagtgcttcctgacaaaggatactggatatttctctttaggagcaaaagtggtgccaccatgtggcaataacataaatatagctgccaatccatttagcttggcaaggcttatatgagcacattacatgaatttttaaaatgttttaacgttcaatttttttctaaattgtatgtacaaagtataactttattatttttaattcagcattttaaaattcccataatttcagttctcataaaacaagagtggcattttctttgaaaaaacagtaatgtaatttgcctgtgatttgaatttggcaaaataaacaaataatgcccttataacactgattttcaaactgagttccatggagcctgcattccctgggggaaaggaatagcggaggaagtgagtggatagaaccttggttcctcctctccgtcttttctaaaacatttccacttttgctggttttatatgttggaactgttcgtaagattttatttgaagaaaataagaaaatatccagccgtttaaagaaatgtttttcttttctaaaagccagtgcagtcctatattaggagtttcagtggggctttaaaactttattttattttttattttttatttttttttttggtaataaagatttactcagaactagaaaacagctaaattctggagaagaggtaagatgcattggttgaaaccctattcctgttatgcaggactgaaaagattagagcagagaaaaggcaaagacatggtctgaatcgcagaagaaaagaaggaaggtatatcacacatggcatttcagctttgtttctcctacttttcccgcatattttcatgtatgttgttgtcttaaacatattaagcattgaggctttcagaaaatattcaactgttttgtgctggctaaaggtaattgtttcctggtggcaggaggcatgaaccaatgaaacttttttttttttttctgtcaaaatagcacataatgatgtactttttgtaagcaagaattcctgatagaagagtgggaacacatttttgaaaaagtttatttgctgagtaatatgtttagaaagaatgttgttagagaaggatatttgctaagaaaaatcatttattcaactaatatttattaaacttacagtataagctacataatatactaggttccggagttataagggaatcccttgcctcaaatattagggtttcataatgagagggaagttttgttagtcatttgaaatagctatttgaaatagtcaaatttgaaatttgactattttgtcatattcataaatatgtcatattcacaaatatgactatttgtcatattcaaatatgacaaatagctatttcaaatgactaacaaaacttccctctcattatgaaaccctatatttgaggcagaggatttccttataactccaagtatttgtctgtgacctagaagaatatataagttgtagaaaaaaatacgggaaaggggacggtttgcaccatcttcctcgtagttcctttagaagtgaatttactttagatcccagaggaagagtattagatctggccacagaagtaactcttttatattattacctatattttctattttaaaacattaaaattttgaatcttctcaagatttcatttttaggtacatttatatcaaattgaattttaatctcaaattacaaaataatatggattacaaactaatatataggttcttagcttctattaccttggagtcccataaattggcttgattttgtttccgtagtgcaaggagctgaataaagcttttactcagttcttaaatagtaaagaactagcaaacattgcgatactttagaactaagtggccattacagattagttagcagttcatgtttgtgttatggtttgttatgactgcttaattcaaaagcatatttgcagacagggagtttggattaagtaaatcaaaatagtaaaggctttgattaagaagttagcttgctttaacttaaatgttgatatttcaaggcctactgatattttagtcatttgcggttatttttgtttcctgttcagacccctgggaaataagagaatagtaaatcaaagcccaggttgctttttgcatttttttccttttcatttatgccatgtagtagttgactttaagaaactaaagacatggataacttgaacagaatcactgtgagggagaattgtatttctggattaatcaatttaaataattcttgttataaaatgattcttttcatgtttgataatttagtaattctttttattccacgataatgttatcgtaactagtggaaaagcagctaaaaatatctgcattactaaagtccaatttgggcagtattgttatcaaactgaggctatgttgtttgtgtctagggatcgctagggcgttgcttcatcagccagaaacctctgtgacaggtggtgccttctgcctgagtattgctagtgcccgtttctttccacccactcggctcaacaggctgcactcggctcgtgctgccagcccagaacccacacctgccaagtacgagcaaggcgtggagcggtgaggggtgtgtgtgtgattgagtgcagggtctagccactgcacacagctgggcacactggctgctgtggtggggcaggcagctccaggcaacaacacaggtgccagctccatgtgaggaggctgaggctggagcacatgtactgcacgcggcttctgctatgggcatccgtgtctggatgaggggaacatggtggcacccagaagcttggagatgcctggaaccactgaaccccaaagagagtgtcacagccccctggctcagggagcccctgggcctgggctccccaaagggccacagctcttctccccttctcatcgcccacaacatggcaagcgggagggtgtgtttcagccctgttcgtgttaacagctcttttagtcccaccatttgatgtgtcccgagttcttgtttcatacccaggaagaatgaggtatgcggacagctggaggctgagcaaagcgaagaggagcttcactgattggcagaacagttctcaagagacccaaagtgggcagctcctttctgcaagcaggtcatcctgacgagtgtccagctctcagtggagaggagacccacagtggttagctcctttctccaggcaggtcatcccaacacgtgtccagctttcagtggagaggagacccacagtgggtagctccttcccccagtcagtagtccagacatctgtgcagccctcagtggagaggtgacctagaacgggtagcttctatcggcaagcaggtcgtcccatcctctgcctcagtctggctgagtccagggtcgttatgcgcttcagaggaggggaagtatgtgctaattggtccatggacggccatgggtgggcctggataaagcaccataagttctcactctggtccacggaactgacagcctggcccccaggattttggctgtccctggcttgaaggtggggcttcaccaggtaccctcccctttctgcccaggagcttgtctgcctcctgccgccatcagtcatgttgttcacggttcccaggctgttgccgaagggcgcctgcaggcccctgttgagctgccctcaatctcccactcatgctctttggtgcccaagtccaaaggaggccaagacgacagggggctggcgtgtcagtgctgccctgagcatgcacatacccagccgggttgcgacagtgcctgggcttggcctgaactttgcttcaaaatcagagcgagtgctgggagcatggagaggccaggcagcgacagcaggcacttccaagcctgtggggagcagaggacctaccaggtccccgactgtgcgcagggatgcctgggtccatagctgcagctgcaccccggagggtggggcttctgcccctcaactcgaaagcgggtgaggctcccgcctgttcccagctcctgcgggctccatggagtgggcagcccccgcccccactgcagctggtgtcatggcagcagcccttctggacaggccagccactgccatcacatgttttcccattttctatttttggtgatagcaaattcaaacttcttaatttacttttcctgaaaaaagttgcctttcaagactacacattttaatgaagagccttcagtaataagcatttcagcatgtctcaaaaaagattcaactgttggttattttagctaaaatgtcaaggaattttgattaactttaaaaggatttaccttttatatttacatttattaatttaatttttatctttaaaatggaagatttgaaaaaaaatcttagcttagcttgcagcttaccagttctggtgtaattttcagtaatataacatggagtattcaatcatgaattagccattattatttaaataattcacggtgtgacctatactgggttatccctactgaagcaaacagcatgaatgggtaagttttattttcctcagtgttcacttactccatgttgtcacgtgtcagcacattgaattttaagagatacagtggagtctaggaaatgcaaaatgacaccttgggtggaaaaacttttcagattgttttcaaatacttacgcagtgttgccagaaatgtgttaacttagaaatttaactagtaaaacagcatatatttgtaattcaaacagtcaaaaagcccagtaagtaattgctttaggattttaatcgggtatgtgtgtatgtgaacatatacatgcagatgtgcacatgtgttactaattttattcccataatcttgtgactattattcattcattcattcattcacaccacacatgcactgaggccttactatgttttcatgttgtactaagcactgaaaacatagtctctgccctcatgaaatttggaatagtggtaaagatagacaaatgaatgttatgaaaagaactgagaaatttaatgggaaaattaaataaaactcagaaaaacatctatattaaatcatgttttagctaagatatgaaggataggactaatctagagaaatgtgttggtattgggggaaaggttttaggaagagagaacacatatggaaaatctctgagaccctggagtgcataacatgtttaaggaactgaaaaatcagtgtggcttgagtgagtggaggacaggtattattgaggctggaaatatacagagaaagcacactatggagaaacaggccagccatgttagagacggaggctccactgatgagtgttagccaggaacgtaacagaagtgctttaataaaacaggcagcagtggcagagagaccttgatggcttcaaaaactatttaggagtaggggccagtcgggctgactcatccctgtaatcccagcactttgggaggcagaggtgggaggatcacttgaggtcaggagttcaaaaccagcttggcaaatgtagtaaaaccccatctccactaaaaatacaaaaattagccaggcatgctggtgcacacctgtagtcccagctactcgggaggctgatgcaggagaatgacttaaacccggcaggcagaggttgcagtgagccgagatcgcgccactgcactccagctgtcagagtgagacttcatgtcaaaaaaaaaaaaaaaaatcaggagtaggaaagataatttctatcaattagataataaaagagagaggagtcactatcacttctctgtttctcttgtgtctgcaatgataaaaaaaaatacagggatactggagaaaagaacagtaagagacagctaaagagaatcccagtagtacctgtacatatgagttgcacatttggtggaatagatgtttaagctggagatagaattgtcaacatagaggaagcaaagccctaggaatggaagggatctgcagtgagagagaaaaagagagagagagagagactcttttccattagtttcccattccatgacatacttccaccagacataaactgttccttcatgcctttattctactttaaatcatttgatgtcagtatgtcaattagcattcacagaataagataagggaaactttttttagtctcatttacatctcacaactaaataggccagattttgtaagggaataaactcagaggctgctgaggggttgaataacttgtctctctgacagtggtggccatggcttctgccacactgcttgttttgtgaaacaaccaagtctcctgcctacctttctgacctttcattccacctgtgccttgtagagtccaatcacaagtcatttgcagtttcctttttcttttcctgttcctgtgtacatgctcttctgctctgagttcacgtctctgtgtttttggtggcatagggagggttaggcaaacatgctttctttgtgaagccttttctgactcgacctgaaataatcagtggtttctctttttcaaaatttctctgtaacaaataacataggacattatttttcagttggatgcctgtctcatgcctttctcctattctcagaacctgattaccttgccctaccctgcccaaccccattttatatgtactttatgtgagctttggcaagcagggaccacattatactttttatttttatttccattgtatttagcagagtaatagcatatgctcaaaaaatgtttgttgaattaagttgataaagaaggaagacatgggcaagaaacatagtgtaaaaggcaggaaggaaactatgtgttaagagacagtggtttagccccccaaaaaggtagcaagagataagtctagagaggtgtcggtgaaactcgtctgtggtaaaatttgttggggcaaacagtatttatgaaacccaatccataatacataacatggatagaaagaatgagactgaaaaaaaggacttgttaaaaaaaatttaaaaaccttggcagctgtcccctctccccaaaacacacacatcctccccactcacgcccccacttctgcctccacctccatctctatctccatccccaccagcttagcttgacttttgggagctagaatcccaaagatccctttcccagagtgctctgctccagacctagcagctgcagggaactgtgggtattttatgattttggagccagagaaacaagatggtgagtgacctccacaaactgagggaaaatgtttgggctttggctgggcttcttctgagcagtagtgcagccctaattcattcttctcttttccacacaatgacatcgaaggtgttttggcctgctattcgtaacgaccccttcacacatgttagcctgcggaaagaagctctactgagcagaggcgatcagctttccccaggtggattttgggccatgttacccaaagaaaacttctgttttctgttttgtgtcactcttctcagtagctttgctctgtaggccagccctggaggccccttctctgcagagggttagaggcctgtccccagtccctcatcatcatatttcaggatggctggaagcagtggttccaaggccaaattcatcatcagtgggaaatacaaactggtatggaagatcacatctggcttttttggggacatttatcaggcaaagaacataaccaatagtaaagaagtggcgctagcatccttgaattctggaaagctaggtatttctcattgcagtcccagagaaaactttttagattcttcagggcgggttagtatttcaacatgagatggtatgattagagcaaagactgcaatgtgctactcttggatcttcagccctcaagacctcttcattttcttttggagaaggctcccagtgaaaaccgtagttaggttagcagaccagatgactggtagaattgcatatgtgcatgcaaagaatttgagtcacagtttaaaccagataacttcctaatcagtattgagtattgctataggaagttattccttattgattttgatttgctgaaaaagtacagaaacaataggataaggcagcacatatcatagaggagatagtaatctctagcaccacttgctaagttagcatcagtgcacatcttggtattgatcagagttttagagatgacatgttatcatcatgatacatgtaaatgtaatttaatagaaccagcctgccatggcaaagattaaagtctgcaacaaagaacagaaaaatgaaaatgttaatgagagaatgataaaatgaaaaggagttgatggaaggtatctactcctgttgaaattttgtataaggggttttctgcagaatttgcagtaaactattgttatggatcacacattaaggaagccttgagacagctattccacaatattttctggaccctgaactgctgatattaaatacatatttggttgaatattgttaaagcagaaaacagtacagaaggcagcctcttcccatggagttagcatgcccaaactctcacaggtttccatgcatgaagggaggaacagaagaagcagaatagataatcagagtaacatttgtatatcgccaaatccagaatttttagttcatatgtcgcattgccagtgttgtgaacaaccatttcccaggtaaaaataacgtaggaataaaatggctctgggcagcattgctgatataaccaagttgtggcctctgtaattatgtatattaactgaagttgttaaacatgctttcaatttttatagcacctttttcagtggaaaacttaactaaataattggcatataccaatttgtgttgagagtttttccatgcctgtgtgtgtgtgtgtgtatgtgtgtgtgtgaaaacctattattttgaactctactgctttgagaagggccatatggttgtatatgcacaaaattgcgcattcttaaagttttttcatacgtaaggcttgcaagttgtttacttaaaacattaaaatggttggcatcttgcttaaggcagctgataaagtagcaacgaaagagtccggtttttgaacatatgaaaattctgtttgttatactatgaatagcagcatctaaagtgaagaagtaagaaatactctgtggtaactagattatccttagtactctgaatgaactctttaacgacccttgaattaaaaaatatttgttacagaaattgaaagctaaacgtgaatgttcatgttcatgctcaaataaatgtaattattatgaacacctacatgatttgggattttggttttattttgaaatgagagctctttcatttacaagttcactaaaaactcaaatgtttcttgaaaatcacaggagcttatgaacattaaaaagaaggaataactattgaacaaataagacagacactgtcaagaacgggcaggactttgcaaggtgataattaagactagttaatatttatgtggaaaagttctgactgggcatttggaacataataatatgaacaatataatataataaatatagcatacatttgcatttatttgcaacctcagacaagcaagatgagtccaaataaagctagcttcatcgtagtcctttcttacatgtgtcacaaggtcttgagatcagtttaaaaaacatgttttatttacaactaatgtgaatactaatatttgctgtcatcagattccttcgaaaataacatatgcatcactggccacctgttctaagtaatttttgaggaatttgcatgttcccagacaaggaatgttgtgaacagagatgattctatttatccactgttaaaaatggcagttaatttttccttgtaagttgatttctaattatgataatatggcagctatggacaatgccctttcttaaacatactgggatgtaaaagtgaccataacttgttgaaactcagtcctggtattgtgttactattatttctcctggggaggcttattagcctgtcacaaaagatgtaagaaaaatccaacattccttttggaatatgatgagcctttgtcacccacaatgcaattaatgttaaaaatagaaagaatggctatgatatgattatgattaggcagagatgagctattgtccaagtaacaggaactaatctagcaggccaaagatgacctacacagaaccatcagtgtgctgattgccatttctctctgagtttgatgaaatattcatgcctttgctctcctctctgcaagcactattgatttcttgtataaacgctgctatatttagtctagacaaatggaatgtggattgctgctgaataaattggatgaaagactgggatcttgcctgccactttctctcagtcttgggcaattatttataatcaagagcagtttttgtaagttgagggtgatttttcacaatttagtgattagtctctgaacaaaggcaagcagttagacgcaatcatttctgttgggatagcaggttaagaagtcaaattaccctttgaggtttacaataactgtttcagagacttgtaggactttttttcttatctttttaaaaaagcttttttagaggtttgatgtttgtagttcatggataacaagaatgccagcaagaagagactccagggtctcttgaatttttacattttgtctttatagggttaagttctgacctttgttttttgagatttccatgtaaaagctgaaggctatagcttggcctttttaatgtaaaaatgaaatatatcattaactgccattgcttttggttggaattatgccaagtcttttagttaatattcaaaatctcatgttactccagagccttgactaaaagttctacattgggtgctacaattaagagatcttacaggccatcattctaatttgcatctgaacttgtcatgattaatttctttcctttcacaaatatcatctttgagaagtcaatgtccaccaaactatagttcatttataaattattttcccattttcattaaagtgacacataaagtaccatcaatgcaaacttctggtcaatccatggcaaaataaccaatgtaagcaacccaagattgatatcagtctgcatgcacaggcacaggcacatgcacatggacattcaactcagatgaccagcaaggacatttaagtatatgaagccttaacatctgtagacaggatttctgttagcctttttttactcactgaaaataactcttaaattcacatggaaaattaactttgtagttcccaaactggaatctgcaaatttaagttagttacttatagtaatagagcattagatgcaatttggaaaaatacagaaaagtaaagggagaatcattcatatttccgtctaaaatacagccatcttctgttctctacatcaccagtcattgctattagaatttaaaaactaatatgatttaaaaaccgtggtagaatatgtgctcgataagggctggaatttttgtctttctttaaaataccaaaccccaacatctagaatgaagcctgggactttaagaggcttgataaatctattttgactacattgcttatatatatatatattttttaaatggttatcatagtgtaaatatcacttttttcacttaatgtgacaacttttttaatgttcccacaaacattatttttaatgaatgcgtagcttttctaccaaatggatgcgacatattttgctgagacatttccttgtagttggtgatttcaataacaatactagaactctagtaaataatacgacattgaactgtttttttccctattcagtattgtctcctggagatataatcctagagttggcaaacctgaatcaaatggtagaaatatgtaacacttcttgatacgtattaccaaattggttttgcataagttttgtaccaattgacagctccacttgccataaataatcgtctctttggtcatacgcttagcctatacaatggggcattgtacacatatatgtatacacgtgggtcatatatatgataataatcaatgatgctctattttgattcataatttgcaattctttactagtgaaggtgattttcagttgttgcattcttttatttgttttgatctagatgttttagtatttttattttctaatgtttagtagaaattgtgtgccattttatttttatatttgtttctaatatgtttgttttgttagctacttactattgatggtttattttaatatataagaaatttccatttcatataataaaaaagcaaaaacaaacatctgttaagggctgtgctacatgctattagtacttactgttactatctccaagttacggatgagggaacagaggcctagggaaattaataacatcttcaatgttacacacatgaaagagtcaaataagcatttagattatagaacagaatttgaaaactggtacatgtaaagactgaagcattttgtttggttcctggagtatttaaagcttttgaagagcctggtgctgtgactcatgcctataatctcagaacttgggagctcaggcaggaggatcacttgaggtcaggaattcaagaccagccttcgcgacatagcaagataataccccagctcccactgccctgaccccagctataaaaaaaaaaaaaagaaagaaaaatttagctggtcatggtgatatgcacctaaagtcccagatacttgggaggctgaggcagaaggatcccttgagccaggaagttctagactgcagtgagctatgattgcaccactgcactacagcctggacgaaaaagtgagccctccagcagcctaaaaaatctttcagtttaattttcagttaacagttatttctgtctacactggatctgtattttctttttctcccacaactcccacaaatagttggttttatctgagtagtgactggcctcttttgaaaagccatgcaatccagtttgccacagtttcccctccaaaattcctgttgtctttagcttaaccttttacactgaactacagaattttcccgattcttgtgggtaagggtcatactcaaaatatttaacaaccagtttggcatggatgctggtcattcaaaatgtcagaatggacaccaacaataaataaatggtacacctggatatcctgtctgtgagttttcctgcttaaactattcctttagaaagcagcattcttttttttttttttttttttgagacagtctcgctctgtcacccaggctggagtgcagtagcgagatctcggctcactgcaagctccgcctcccaggttcacgccattctcctgcctcagctgggactacaggcacccgccaccacacccggctaattttttgtatttttagtagagaaggggtttcaccgtgttggccaggatggtctcgatctcctgacctcgtgatctgcctgccttggcctcccaaagtgctgtgattacaggcgtgagccaccgcgccgggccctgaaagcagcattcttatctactaagagtttttgctaagaattttatatctattatctaatttaatttgtataaatttaaatattatcatctgtagttattctcagatcatcaaatcttttttactccagtggtttgattaaatacttgttttaagtttcctcatactttttccaccttgtttattttaggaatgaggtagctgagatacagattattaccaattcaacatcaggacttagaaacttggctactttcactccttgttgtttggatctggcaccattgctgtggttaattaccattttccacattttagcatgcagttgtctattctgtctttggtacatccaatagtgctgcaaatacgttatattacaacctttactttgtaaagttgaagatatcttctgacgctgattacaaaggaagatgttcttaagtgtacaaatgtagtcatggtggaagttctctcttagggcatcttttcctcaacataattccatttttttttttgtcctcgttgacttgatttttgttagtggttcagtagaataagttttatgaatgactgataccagtaaacaattgaagtcacctgtttgtaaaaggaaattgtggaggattcatggcagagtgcaaattgctgaatgaaaattagcctatggcccatttatcaaaactaatgtacaaatgactttatatcatcattgtaaagaaatggctagagtcattggcataaaatttgttgtacagggtcttatactttttatttgtttccaaatcaatgtgctaatttccaatcttctattaccctcccccaccccatttccctttttttctggttctttagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggtagcaaatgcttctttgtctgtgaccttactcaggagtctgcaccgtggtgggcatgaacagtgcccatgggaacactttgcgggtagattcactgtgattaagacatggatatatggcttgaagggaattgtgattttactagtgaaaactttgggtaagtacctgttaaaaacctgttttgcttctcagagggaccttctttatcctttagcacatagaatcaatagcagggaatagtaacttcctatcctaattttagattctctcctacgtgattttgttcatttgccccatctgctctccaccaagaagaagcatgagcctagaagacccatttcatatttcatttctgaagagtctacatgtactatttgtgagaaaggataaattagtcaccttatatgaagagagctgtttttaaaaaacaaacatggtgtataagtagatgttctgagtatgtccgactcttccttatagaaaagatctcataatgtacacattcaaaataatagtataataaaaagcttaagggagttataaatggagaaactggtgcaaatgtttttatagactgtagataagaatttattgaaagtatttgggagtagttgacaatttgagactaaagttgtttaaattattttagcacaaatatatccatattccagaatttttaataataacttattttattatctaataatattagatgtgtctgtttttttaaattttgtatcttcagagataaatattactttagctttatttgtaaaacatcttgcaacttcttgacaaagacagttgaaacaaggctatttaatttgaatttattgtgacagaaaagcagcaaagatttacaacaaaaattttatttttatatctaactttcaaagatgacaaacacttgctaatttgtgaatgtaataaattatgttatctcatactttattgttttgtattataggaactttattacttgcatatcaagtacaagcacattgatagagggttgatacagataactgatgttactagtatgtaattttaccacattaatatgacagtttctaaggaagtaaaaatgctatcttcttctctatattacttggtttacaagatgtttcttaatcctaaaagaactttattatcgtatattcctaaaaaggctctttgacaagtgatataaaatatatttatttcttttagtagtgaactttccaaaaagaactcttgtatattattgatgtacaaaataccttaaagtgagagtattttcttttgtcccaaatggaatcagtagctcatggctacattttgaagtatgggtagcctttctttagtttttagacttatttttgaatgaatactgaagctttatttaaatttgacctttgaaacaataatagaaacattgatatctagatctgtttctttccttccagcatgttaagatggcaaagagaaatgagtaaaatgtacatttttcaccatactttaagatgtaagggactgtgtagttcattttgctgctttaagtgagacatgtttccctaaatacagggcaatactgataagttactgctttagatacttcttttcatttatattgctgcctttgatagctataaagttaatataaattgtttagaaagaaatttattgcttaattttactcaaaaggtaatagtagcaagtagataattaattgttcatttggcacaagcaaaacaatagtgttggtttattgacatctggaaaatattggaaaagtggctcctgtgagaaaaaagaattatgagatagctaaaaggaaaatttagcttttaaaatgattttccaaaataataatttgttttcttagaaaccaaagacataattaatattactttttcagattaggaagttttttgatttttagaatttttattttgttttgtcttgtattttttatggataaagctaaaagttgatgcttttcattaagattttatttttatgagaaagatgcattacatgatgctttatttatattagctttttgaatcgttagcttctgtaataatcaacatttgttgagttagatgctgttattccatttttccacctagtgaactgaggtagagaaaaataatgatacctttccaaggctacatagccaataaattgttgctccaagatttacagtcttgccctgtctgcctccaaagctcttaagttgccctgcctctctcatgggccagaacatctagcaatagagggctaaagttttatttctttctattgttttaaacctcattcatgcaatctttgataatgaatagtagtggtaattaaattgtgtgcttttctagattcctatgaaagattaaagttcaaatacattggggctttgggtgaagcaccaaattaatttgaccaacccaagtatctatatagaatttaacagtaaggcagaatttaagcattccttctgctaccatggaatattatttcattacaatggaataataacacccattaagggagtgtattgaagccaaaacaccaaagattttaatatgaagagtaaccagaaatgcttctaactatgtccttctgggagtaataaggctattatggttgatatacagagttagcttcctgttgctccagagtgactctgatgccattccatataatagctttttatttttgttctattactttttggtgtaaaatcaagagttttaggcacctaatgtaaaaaacaaaatttactaatttcattagtattgaaagttacaaacacatgttgggtatcccttatctgaaatgcccgggaccagaaatatatcagattttggatttttttttctggattttggaatatttacatatctgtacataatgagagtcttggagatgggactcaagtcaaaaatataaaattcatttatatttcatatacaccttatacacatagcctgaaggtaattttatacaatatttccaatagttttgtgcttcaaacaaagtttgggtacattgaaccatcagaaaggaaaggtgtcattgtctcagccacccatgtggacaatctctggttgtttggcatcactgttgttgctgagtctgaatgtgaggaacatgccattggcatgtcttgcccacacacacaccattttgttatcttttgtgggtgtgcttatgtgggggaatctgggcgtgtgtgaaaaaaatatattgcagctgaaagggggctggaagggtcttttttcccatggtgaagctgactaaactttgtgctgtgtgcctgcattttgactggaactcatcacatgaggtcaggtatggaattctccacttgtggcatcatgtcagtgctcaaactatttcagatgctggagcatttaggattttggattttcagattagggatgcccaacctataataataataattaaaatcagtagggttcaaacttaaaaactaaattttatgtacgttatgaatatgcggctgaagagagatattctctctcttacatatgaggaagtatggctccgagtagtttagtaacttgtccggatttcatatctactaatgtcagaacctaaggagaactcaaggtctttagttactcctcagtgtgcacatttactatagttcatagatatatatttctcagtctgagtggaaatagacatctcaagatggctattaaaaaagaatgcttcaggctgggcaaggtggctcacacccgtaatcccggcagttagagaggccaaggttggagcatcacttgaggccaggagtttgagactagcctggggaacatggcaagactttgtctccactaaaaatgataattttaaaaaattagccaggagtggttgtatatgcctgtaatcctagcaacttaagaggctaaggtgggagtatcgcttgagcccaggagattgaggctgcagtgagctataatggtgccactgcaatccagcctgggcaacagagtgagaccctgtctcaagaataaaaataaaaataaaaaagagtgcaagaatgcatcatattcatgtcattcattgtttgagagtgaattcaagggattcagaaagctaaacaatagtgcattaaaatgaagttttgtggaagtggtttcttcttgaccagtgtctttaatctaaaagcttttatgtgctgaatgaaagaataaagcttctgctattttgatattttgagagactatatgtatataatatattctacatattatgaatatatacattgcattagtctattgagaacttgctctgtaagattttgaaatttttagcatttgtttacttcaggtaaacttcccccaaattaatttaatatctcaccattctgtatttgcgttgattatttttacaccattttttaggctaagaatggaagatttcagttgttcatttataatgtgagggactttgtaaaataggcttctgggcagtccctaccttttcctgtttgtatgttcaaagaaaagtcattaagggaactaaagatttaattaaaggaaatgggaagacctgagtgaatttaacagttagttttgatagggatgcacagataatggagctacctaaaacttgcctgttgatgacgttaagaccttcactgcattagttgcttgtccttagatttcaatgatttacagaaaaagtgggtacaaatatgaactaaatacaaacaagttccaaaagctcataacatttcagttttggtcagtgatgactatgaagcctaaagaaattgcacactctcatgtctttctcttctcgcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagtaagaggcaccagggtaaacgatggactctctttcctcatcgttagctgatcattattcagaacaaagcctgataaagagtgcggttagactcgtcaaaattatctgtgtttaattaaaagcatagattacagacccaactgtaaagttttgacatttacataccagctcacatcattgagtctgcagagcgtctcaagaagcaaacgtaacattatctggcaaaggtgctgatttctgttgttttgaaccttaaaaataatgtaattctaaagcagtctaatatatgccatcttgtttaataatcagcttgtatccacatctcctgactatgccttccttactcctggccaagtaataattgctctctaagtaaagccttgcctccatttagttttggcatactcaaactttgagaagatttaagacataacacatgcaaaagaactatccacaagagggagacagatccaaataattcccctgtattaggtcagttcaaaatcaggtcgtagcaaagtttaaaatttgatgacttgaactggaattgtcagcaatatttatttgtttaatgctcaaagggtttttttaaaaactaaggttttcaaactagcaactcagaaaagattattttaatgtgtttaagggatttaatatggatctaatccctcaagataacttgattattaaaatacagtgttttgttcctctgcagtattttttaaacttaaaaaagttgattttgggaattccctctttgcaaaagtaattaaagaaatagctgaaagtcttttgaaaatttgcaatttaagtagtatttataaagcattactgtactattttctaaagcatatttggactgtggtttcttcttttaataggaaaactttatgtgctgtgaccagcgattttacttcttaatctttgtcaaatattctagaggcatgagaggacaaaactcaccatcaacatctgtttctgtgtgtgtatgtgtgtgtgtgtgtgtgtgtgtgtgtgtgtgtatttcaggggcagtggcaagtacagaagtaaagcagaagcttcaagagttcctactgagtaaatcagcaacgaaagacactccaactaatggaaaaaatcattccgtgagccgccatcccaagctctggtacacgtatgttcagtgtttggctgttttcattcctggggtaaagaacacaggttctgtatttagccgacctgggtacacatccttagcctgccatttctcagctgtctggctgtgggcaagttccttcagttctctaaggatcagtttccttctccataaaaagaggaaaataatagtgcatgccctctagggttgctggcacggtcctataaaataacatggtaaggtacataacagagagaagtgctaaataaatggtagcatttatcaacttgagggcaaggaagtatatatgttctttgatgaatgaataactgacaaatgtgaggtgggcaaagaaatttgtattttgcatttttccattctcaactggtgcatttggtatctatatagtaatttcaaaaggtttagcagattgtgattttattacacttgacttggtgtaagatggaggtcagagctattttcaaaaatctagtagaattttgtctcaaatgaagaaaaaaggaaggaagaaaggaagataagggagggtagggaagggaagttgagaggttgctaaataaataactctaagtcttcagtgaatagtttacccctgcccacctcacttcatttcttcccagacagcaaaataatagcttggctcctgacacacaacctgacaacataatacactgtggtattgtggtttttatagaactgtatttctgtaagtccaatacacaaatatttcaataaaatatagaggatgtggtgattttaaaactcagggcaaagaactgataggcaaatcatatatggataataaactaatagataatagtttcatttctttcttagaagtgtttgccaaatgaccatatatttttacacttatatatttttcaatccctcacaccattaaagataggaatagtacttgattactctgttatattaatattgtaagcagcctgggagttctatttaaagagttaatgtacttataaggctattttataggtatccgcccttctctgcatcccaaaacaggtaacagacagataccataatgttttataaatactttttaatgattttcataatttctgtcatgtatatcagttgacatgaaaaacaaatctctgaaaaacaatttcaaatattcaatcaatatcacgaatgatttaaaaagaaacacgattttgttacctaaaactacacacataatttatagctaattcataattcaaaattaaagtctgttctaagaaaagataatagcattaaatgagaaacagctacatgcaaagaatttgtcggttaaagttcattagctgttctcttaggtaatattaagcatagctctcacatgttacttagcagtatttaccttgtttttatgaaattgaacttcagtagagtccaactgcagataaccacaaacgattaatttatagaatctgaatttaatgccatttttgccagttatagctagaagaaatatccttaaaccaataaagtcttaagaatatatgatttaaataaataatactggtagaacaatcattgtgatggtgatactatgtcctgttcattgttttcattacatatgtaattatagatatttatatctactagatagtcaatattcagtcctataaactattctccagcagcacagttgcatctcttagattgtattcacccaggaaaaagaaaacatttaaaaaaattggtttcatattaaagaatgtgatccccattctttactactgaaactgccccagaagtcaggagatgggagtccgttggcacaatcctgtcttttcagtaaaaaaggctactctcatgtactcacatgtactatctagcaattttttaaaatgaagtccttgcgtatgtttactattaccttgattgttttatactgttgactagaaaggattgagatgatgacttttcccctagggtggctcttaagagaacataggcagtaatctcaaattgtcaaaagctcagactcttggtaaattattttagtgaagcaaactttctatgtgactgtatgaccaaacacatgctggacatccttaggatccctgcatcattccatagcatactgctacagtgaacttggttatgtgaggctatggtttgtatacactaaggagaaagagcataaacatagctgaggcacgtgtacagcgtgtgcagctgattattgctgaccaatatgcagtaaaaactaccaagtaaatagtgaaacttccttgtcttttctagggctgcccaccacacatcattggatcaaagctctccaccccttagtggaacatctccatcctacaagtacacattaccaggagcacaagatgcaaaggatgatttcccccttcgaaaaactggtaagttggtttaacaggaactctgtttgctcttctgtaacacacctgtaagtttcattttgccacacctctagaagaaagtcaaaggatttgagtcgtagataatatacctccccacccctgcccccagcataagcaaacaatgcacacacataccctacttatttctgcatcagttgattcatgacataatcaaaatatctctttttcagtttaaaagtttatcatatttgaactttagccaaattattttcttactaggaataaataaaaataaaaatttcgtatctcggaaaatctaactcttctccattagatagggcctctgtaatatctttcattgtcctgtttttctgctgtacctcaaccatttaccacaaaaacgagaataataaagtttaatttttccaataaatattttacaaaccttaaattttaattgtttttgtggtgaaagcaggtaaggccaaagctaccttctgagtaagtgactagcctaatatctcatggattataatagaactcagagtgaaattatatctgataatctcatgaagttaggggaaatagcgcaattaagcttttatttagaatttagtaaacagttctgtggctctaaggattgtatttgctgttccatcttcatctcctttctgagcattctgatatgtatatatttaatgtcttatatgcttttactgctataataaatgtttaactagatatacatataaatagcatttgtgtacattctattctaaatctcaacgttgtttgccaaatatagttctttagagacagtagtaaatttaaaaatgtttatctccacaactgatctgaaaagatattcatgtaagatagcttggtctattgtatttgactcagatctacttgaagaagtatagatttatttgttttatatatgaaatctgcagagtgaaaatgatttcaaataattatattcattttcccaagcaattttgagaaattaaaatgaatatagattgtaaaaacacatgccgaagctattttttgtcatataatttacctgtggcataatgaagattttaaaataaaatcagttatgaataagaatttattattcgccatctagcatatattgaaggcactaggaaaggatgtttaactattgcaaaacaacctgtggctttttaatttaaatagcccaaatatttttgcatttctactaaaagatgataagtattataaaataccttaatagaaggctatgcaaaggcaaggataattgagttttatgtattgcatcagaattccaccctattatctgcaaatcagagtgtcttataaataaacttttctaggatgaaagaaagcaaaatgtgagcctctatgttatttctaaaacatgagtatagtttatgaaaagtgatccataaaggacaggagttttagaatgtggggactttgatctgcaggcttgacatttatttgtgagtagcatgagtaggagctatttactgagattatgcagatactaccccaggtcttagggcagtgaatggcattcaagaatctaaggagttactaaaaggaaagaaaaatatggattccccttatggcaggaggttactgatgagtgatatagttacattcacagagaaagacttctatcctgctgagcacagagcctttgaatatatccttaccactgggagattgaaaactgactgcagaactgataactgactttgaaaagaagtggcatttgggaacattaagcacccagtgagaaaatctgatatttttaatacttaaggagaagtactaaaaacccatactttgtgtcccactgttgccatgcgaacagcttaaggtttttcctctgtgaagaataaataacaagctgttaatttattctcatagatttttttcaatccacaacacaatttaaaaagaaatccttctcaggatatatatgttacaaaccctatttagatttgtacaaatatgcaagacattttctgtgccttattatgtgctatataataatagtgaaaaatccctggtcttttctagaggtattttttctgtatttgatcagtatttcatgtttcttccttttatgttgaaaatctgatatttatgaagtgtctggctgttgatctgtaaaaccaaacattttcaagcatcgtagcaataaagttcttgaacagccattaatactttagtatctctatagaggttttaaaatattccttaattcaattccaattgtctgtttaagaaaaataagatgtaattaaatacagatgctttctatactctatctaaaatacttagagatgcccttcattaattacaaaataggtggaacactcagcttttataaatataatccatttggtgtatttccaattccattatgagaaaatttagacatatatttgcactaaaagaataacactgaaatgttgtcaaataatttttacttcaatgtttattgtatttcagtgactcaaaagtatttacaaacaaagcgaacaataaaattttaccataataaaacatatgtgatgattggggaaactgtttaagatagcttgtgtaaagctacatcatactaaatgaaatctggaagagtgtcattgatcatagagtgtaaacaccagcccagctactgtagagtgacgctttgttattagagccagattctaaacctctcttgtctgcttggatttcattgaactcaatcttagagttaaaagaagttgttaaatgagtgtatcctatcgtttgatctatgtatgatactattttagtttcttttaaatctacatcagcaatatgtattagcaagcaagatttacgagagtaaaactggaatcagagttagaaaagtcctaatgatcttacattgattgagatagccctaggatgtcccttaagcagtgagcacaatttgaaacctctcttgaccttttaggaccttccccagacagtgataacccgggaacagttaactacagaaacctcatttgcctgcagaaatctgacctttgtcacgcaaagtggacctttacttccttccccttaggagaatgatagttgctcctagaatttgggcattttagaaacatggaattatattaaaagttggctctaatcatgcccattccaattcacttttctttaaaatgtaagaatggagtgacttctcctcctttcacaacaacatcaaaggctttacataacttattttgaagtggaaaataacaattgtttttaatttttatatgcattgcccacacttaaagtagtacttccttctagaattatacattgtaattaattttgttctataacacaaggataggttgataggaaaatttggaatattttactaaacttatactttggctgaaaatagtatcattgctgtagtagatgactttattgtttttatatagtacactgctgaactgataataaactatgaagtagggaaaggaagttttggaaatagtacatatttcctggcactttggaaatggtacatgtttctcacagagattctacatatgtggtgattttgaactgaccttcaaaaccatttgattggattctgttccagtgagtgtgtgcatatgtttcataaaatattgtgataaaatttctagaagttttaccctccattatattattgaggttttacccaatgaactttgcctttctttgaatattacagtctttccatttaatacttctgaacaaagtgagttagctggctagattaacctcttaaagtgcacaagccatgtaaagcttggcttgggctgataagagacttttccagccccactgaaatatttattttaatggtcagcaacactagaataagactcaaagatggaaagagtccaaacataagtgaaggttttggaaggccagtatcattttccacactgagtaaactggaacgaaggcagagattagatatgtagctttataaattgccttttggtatagcagtcagcagttatgttctagtaccttgatgacctattcaagtcattataataaaaaacacaataattatttttaatagtttagaatatctcttcctctctctctccctctttctgtgtctttcagaatacacttgtgcatgtgtgaattgcatacatgaacattatacacatttctgcaaagatatcattaaagatggcttaggcttataacgatatttgctcaaaatcttattcaagattgacgaacactggagcatttttatatagcttagtactctatcttggttacattgttttgactaaacttgtcaaagtttatttttattgaaatatacttcttttaatgaatcttatactagttttctcagaattgagaagtaatatggccattgtaattcaggctttgaatccacacataccacttggaaatttgggtcctcaatcttgagcgattaatttaacctctctaggccacgattccctcatctgtcaaatgaggataataattgcacttggtttgcacagttatttttagaattcaattaaataatgcatgtaaagcacttaggatcatacctaggatttaaggagtgcttactcttgactgtatgcttgtataaggaaatgttatttatttctattatgccaaaactaaatctctttttgttgtagaaggtctttttaatgtcttacattcttctacctttattaatagaacaaccaaactaataaaaaggtgatcaatattttctttttaagctatgggcaactcacaaggctactgtcaaaatgagggtaaagttatttgttaattttgcatattctctggtatttcagagctcactatggtatccaaaagaagcagcaggctgcatgcctatagtcctagcgactcaggaggctgaggagggaggattgcttggcccaggaatttgagtccaacctgggtaacatagggagaccctgtctcttaacaaataaaataaaaaacggagcagcaggcttgtttttgttgttcatcgtaggaggaagtctgattgatgttctgtgctcactagggccagagttttaatttctgctgttaacttcatttttaaagtagcagactttaattttaagaaaagttttatatttacagaaaaattgagcagatattgttgagttcccatattgttgcctcctcctaacccctaggtttctgctttttaaatatcttgcatcaatgtggtacatttgttgcaattaaggaacaactattgatacattattgttaatgcagtccatagtttatattaaggtttactctgtgttgtaagattctatgagatttaacaaatgtgtcatatcatgtcatatatccaccattacagcatgatatagaatagttttaccaccctaaaaatctcctgtgccccacctattcatcctccccccacccaacttttggtaaccactaatttttttattgtctctatagttttgccttctgcagaatgtcatagggctacgatatgtggccttttcaaactggcttcttgtatttggcagtatgcatttaagattcttccatgtattttggtagattgaagcttttttggttactgaataatattccattgtatggctgaaccactgtttatccatttaccttttgaaggacatttttgttgcttccaaattttggtgattatgaataagctgctataagcattcatatgcagtctttgtgtggacatgttttcagctcaattgggtaaatacctaggagtacattaactggatcatgtggtaagacttgtttgttaaaaaaagaacaacaaacaacaaaaaactgtcaaactgtcttccaaagtggctgtactattttgcatgaccactagcaatataacagagttcctgttgctccacatacttgttagcactttgtattttaagttttttttttttaattttagccattctaatacgtatgtagtggtttctcattgtggttttaatttgtaattccctaatgacaagtggtgccaagcatcttttcatatgtcatttgctatctctgtatcatctttggtggtgtctttttagatattttacattttttaaattggtttttttctcattgttgagatttaataattatttgtgtattttgggtacaaattctttttttgctgtttgtcttacaaatatttttcctcaatcagtggtttatcttttaattcttgtatcattgtctttcacagaacagaagattctaattttattaaacatcaatatttcctttcatcgatcatgcttttagttttatatccaaaaattttttgccaaacccagcgttaactagattttctcctgttttcttctagaagttttacaatatttcatttagatctataattcgttttgagaaactttcaatgaaaagataaggtccttgtctagattcattgttttccatatcggtgtccaattttgctggcaacatttgttgaagagactatcatcctttctccaaagaattgccttagctcctttgtcaaagatatatttgtgtgggtttatttctgggctctctattctacttcactgatctacttgtctgttcttttgccgataccacactgtcttgattactgtaacttcatagtaattcttaaagttgggtactgtcagtcctcttaactcttcttccatattgtgttggctatcctgagtcttttgcctctgggtataaagtttagaatctgtttgtcaataaccaccaaataacttactggaattttgttttgttttgttttgttttgagacagggtctcactctgtctcccaggctgcagtgcagtggtgcaatctcctgggctcaagtgatcttcccgcctcagcctcctgagtagcttggcagcataggcacacaccaacatgcctggctaatttttgtatttttcgtagagatggagttttgctatgttgaccaagttacttactgggactttaactgggattatgctgaatctaaaggtcaagttgagaatagccatctgaacaatactgagtttttctatccatgaatacgaataattctttcatttagattttctttgatttctttcatcaaagttttctagtttttctcatttacatcctctacataatttgtttgatttatactttcctaatttttttggtattgatgtaaatgttactgtgttttaaatttcaaattcaaatggttcattgctggcatataggaaagcagctgacttttgtatattaactttctatcttgccaattggtataacagcttattcattgccagagttgtttgttgtcattggttctttgggattttctgcatagacgatgtgatttgtggacaaaaacgttactttatttcttcattcccaatctgtatgccttttttttttctttttcatgtcttattgcactagctaggacattcagaatgatgttgagatgtcgagcaggagaagtaaaaggggacatcctcaccttgttcccaatgtcaggggaaagcattttgtttctcaccatcaagtgtgatattagctgtagattttgtgtttgtgttgtcaaattcaggagttccctctattcctaattttctgagagtcctcacaaattaatgttgggttttgtcaagtctcttttctgtatcaactgatataatcgtacgattttttaaaaagccatttgatgtgatggtttacattagccaattttcaaatagtgaaccaacctcatataccaggaaatcctacttgcttgtgttatacaacactttttgtacatcattggatttgatttgctagtattttgtggaagattttaaaatctatattcaggagagataattgatcaatggctatctattcctataatgtctgtatctgattttggcagtatggtaatgctgtcctcatagaaagagttaggaagtagtcctcctattttctggaagagattagagtattgataccatttacactttaagtatttggtaaaatttactagtgaaaccatttggacctggtgctttcctttttggaaggttattaattattgattcattttctttcattagatataggcctatttaaattatgtttttctccacttgtgagttttagtaatttgtgtttttcaaataattcatgtgacttttcaaacttgtcagtatagagttattcataatattgctttattatccttctaacatccacagcatcaatagttatgacccctctttcatttctaatattagttattagtttcttctctcttactttttttttcctgacagcctgactgtagtttcatcagttgatctttcaaaggaccagttttttgttttgttgagttttctctcttgatttcctggttataattgtcttgaatttcccattaatttttactttttttttctgcctactttaagcttagattgttatttttcctctattttttttaaagtggaagctcagattattcaatttttatcttttcttctaatatatacacaatgctataaatttgcctctaggcactgcttttacagcatcccacagattttgataagttgtattttcattttcatttagttgaaaatattttgaaatttatcctgagagtttttttaagtcatgttttatttagagtcatgttatttaatttctaattacttgagtatttgctagctgtctttctgttatttattttaatctttctgttattgatttctattgtgggctgagaaaatactgtgtacacattctgttcctttagatttgttgaggtacatcttatgcctcagaatgtattctgttttggtcagtagtactaaagtctccaaccgtaataggtttgtctatttgtccttccagttctaacaggttttgcctcatgtattttgatgtgacattattaggagcatacatattaaggattgttatatcttcttggagaactgtgactattttatcaatatgtaacaaacaccacttttatcttcgataatcttcttggctttgaaatctgctctgtctgaaattaatatagctcttccaacatccttctgtttagtgtgaacatgttatatctttctccattgctttacttttgatctgtgtcttatatttaaagtgggtttcttttaggtaatatgtagttagaacgtcttgttttttaaatttactgacagcctctcttcgtgtattgagacaattcacatttaaaatgatcattaatataattagattaatatctagaatgtttgtaactgttttcttcattatatttacttttttaaaaaaatattcacttctctctgactcctctgctattcagaactttatataattcagtgctctctactctcttaacatatcaattttacctcttttaaaaatatgtttcagtggtttctctagagtttgatgaatccatttatagtgaatccatgtccactttcaaataacagtataccactttacaggtcatacaggtaccttataaaagtgtatttctaatctctcccttttattctttatattgctgtcatttatttctgttttccaaaagctacaattatccagtattttgttcctattattattgtgcacagttaactattagatcaattgataataaaaataaaagattttcttttaccttcatatgctccttcctttatataggtctgagtttctgacctatatccttttccttctcactgaaaaacttttaacatttcttgtatggcaggcctacaggcaataaatgtccttagtttttgtttgtccaagaaagtgctttatttctccttcttgtttgggataatttgtgttctttttaaaatttttttggcaacattttgtactatactttcttttttattctacagcttatgacaggacatctgatctaaatcttatccttgttgctctatagataaagtttttctttttttctatggtttctttgaagatctctttatcttttatcttctgcaatttgaacatgatatgtctcgatactgagtttttggtatttatattgtttcatattctctgagattcctgtatctatggattggtgtctgtcattaattttggataattcccagccattattatgtcaaatatttattctttctctctttcttgttattttgctattcccattaggaatatgttataccttttgcaattttcttagagtattggggaattctgttccatttaaaaaaattgttttttgcctttctttttagggagtttctattgacatatcttcaaagttattgattccttccttagctgtgtccagtctactgatgagcacatttggaccttttttttttttcttgagacggagtcttgctctgtcgcccaggctggagtgcagtggcgtgatcttggctcactgcaagctctgcctcctgggttcacgccattctcctgcctcagcctcccgagaagctgggaccaccaccacgcccagctaatttttttttttaatttttagtagagacgggtttcaccatgttagccaggatggtcttgatctcctgacctcatgatccgcctgtctcggcttcccaaagtgctgggattacaggcgtgagccaccgcgcccggataagaccttttttaaatttctactgctgtgcttttgatctccagcattcccttttcaatctttcctagagtttccatttctctgtttatattatccatctgttgttgcatgttgccaacttcccattagaacccttaacatactacttttagttcctttaagttccctttctgttaattccaaaatttgtgtcataactgagtctggtctgatgtttgctttgtctcttctgattgtttttcttgccttttaggatgctttataattttttgttaaaagcttgacatgatatattggacaatagaaattgagtaattatacttttgatgtgaggttttatgttaatctggctggggctgggctttgtttaatatctgttgtagtggtaaatgtcagagtcttcagttttctctagtttcctttgatttttttccttctcctattgctttggggtttccctaagagctccttcttaaatagaatttgtgtcctgtagctccctcagttttaattcactgttataatacagaacctggttgatgtgatggtaaggcgttggacaggagaaatgttctataaccttacaactaaatttcatttttttaagtgggcctgactttgtatgctgtgatcccttgaactacttcttagcctgtttcctccccttaagtaagataggaagctgagatttactaattgccttctcccttaggtcagataaggctctgtaaaatattttcccttggagagtaggctgttgttatgaagaatccttcgtgtgtatttcaaaattgttactttttcattagacaagtattacaaaatggttacttttcttccctctcccacgcctactccctaccttcacttaaacagaaagggatttttttctcatatattcactgagagaaactggttgggttcctggaagtaaaacccatgaaaatgtaggattcttctgagactgggcccctggagttttgtttgtttgtttgttttttgagacagagtcttgttctgtcgcccaggctggaatgcagtggcatgatctcggctcactgcaagctccgcctcccaggttcacgctattctcctgcctcagcctcccgagtagctgggactacaggcgccctccaccatgcccagctaattttttgtattttcagtagagatgggatttcatcgtgttagccaggatggtctccatctcctgaccttgtgatctgcccacctcggcctccgaaagtgctgggattacaggtgtgagccaccatgcctggctgcccctggagtttttaactctcaagctggttcacattcagcctccagcaattcatgcctccaacacctcattaaaattacctcatttaaatatttcttcgttactgactccattggcttctgctcactgtaagctgaactcagctgtgattttctgtattttcctatttctccagattttagcatggcagtttgccctgcaaccttaattctctgatagatctacgaaaataattttaatttttactttgttcagctttttacttgtggtgaggttgggagtgaaaatttcccagttcttcacatgtggaaatgaaaccagaagactaccacttacttttaaatctgtaaaacattaaaaatactttttaaaactcaactttttcattttttgaggtgacaaattcatatttgagcaatattattcttacaaattaatgattatatttattttaaagattaacatcagtgtccagcttgctcatgattaacaagttcatatgctaaaaactgagagagagaaaataggttgaaattattttaagtcacattttgtaagcaagacttgggaattgtaaggactttttgtcgatttttgtcttactgttttcataacattaaaccatttagcaaggtatgaaaatcaaaccaatttttgacctgtatcaaattagaaaattttagcttcttttcaaaataagactcacttttaaagtaatatttttttctagataataatttactttttaagcattcattttgatagatgtaatcatttagattatgaaaagttggcaatttcaaaagaacatatttagttgattttaagatactcattttttaaactaacatatctgaaatctgaattgctctcatggatgtttatagtttagtagtgctttctggtggcagggagttagtggtatacaaggtacttgtaaatgttgtaattgattaattaccatagtatttacccaacaattaaatggtccagaatactaagattcctcatgataaagaaataatacaaatgtataatttatacattttttactttaaaataacaaacatagtagaaattaataatcctaaaaattttttatgaaaaagttaagtatgttagtttcaaatcaatgaacaaaatgatttaaatttcacagttcagtaagtgagaagctggtttcattgattgcatatgcaatttgtatgacaagtagttggagctaagagcaagtatcaaatgacaattgtgtgataatgagtcagccttgtaagaacttcgaaaatctaactcaaatattttgcttgcagaaaagctaaggtagcctagaaagacaaagcatggaaaataatttcatggcttggcattagatgaacaaagctgagaattctagcttggcacttttgatgagagctgtgtgacctgcacatagtgcaggatttctctgagcctcagtttcttcaaatagcaaatatggaaaatatttgccttccagtgttattgtaagcaaaaatatactgcccagtacagtgtgtgacatgggtctcagtacatattgccagtatgaattattaagaataatagtatggcattagtgacaggaaatattagtagtagccatataatgtaattattgaagaactagaatggcaaaaggagacttaagttttaatcttaaccttgtcactaatacatgactatgagcatagtgcttcatgattttagatttctgttttttcagttaagtgcaaatggaccaaatgattcctaagattgtatatgaaactaagaaggaaatatataattgcatttcataaagaggtgtgataaaaatatattaatgatttgaagaatatataagaaataaatgaccatgcttttgcacagtggtatctcaaattaatcataactggtaagtgcagaaaagtctaatgacatatttttcactcctcatgaaatgctcatttagaacaggcaggacattttagataagattggaatgagaaaatggcaaaaaataataattaagactttaaaagcatttagccatctgttgtataatcatgagatttattgaaaaatgattcctaatttatagtattcacaactatagaactgagaacactgaggaaatattccatgcaaatgcatgcatttatatgtctttagacttacctaatgaagtaaattaagagatagaaaataaatgatgaaatatttgggattgtattttccttaaattttcagcctctaactcagttactttaaaatggaagtgttctttatggcaaagaaattggagagaggagtgggaggggagggggactggcttaagaaccatgttattattaaaagcagcacataataacagtttgacgtgacatgtaagattttttatcaagtgactttattttgctttatgtgtatcagcctcctgttttatagatttatttgctttttagcctcttatttgcatttttatttcaatattcacagtgattcctccattatttcccacttattcatatacaagataaattctaaagttatttttcatagaaccttcattctaacacttcccttatctgtattctcatatcattgtaatttttgctataaaagctggtaattttgtcaattatgagatattaaattttataatgttgtttttatcctgttcatcccaattagatgataaaaatatctgagaatataatgcttgtaacatcttcctcctttatttgacaaaccacactttgtgctgggcctggacataaatattaaataaaccagtataagtaaaaaaggatttctgacattaaggagctcacagtcttcatagtgaggcacatgtaataggttcctaatagattgattgatactttaattcagcagttgaacagttgaaccaccgtacttcttgaggaactactatttcatattttcagattataggcattcttgagtgaaagcaaagatccaagccacccgaggaatatagctgggaaaagacattaagatgttattattattatttttttggttgtaagccttcaatatctttatttcaaaatgcatattttaatgtcattatatatattttgaagtaggtaatacagaggtaattaagagaaattcttggagagaatgcattagcctattgtagctgtacatatgtggttctttgaaaatagtatggaccagcactgccaaatataatttgatggaagagttctatattggcatggttcaattcagtaggcactagctgcatgttgccacttgaaattgaacacttgaaatgtggctagtatgacttaggagctaaatttttgttaactaatgtattagttagctcataactaattttgttaactaattcatttgaatctaagtttaaaaagccacctgtgtctagtgattatcatgtaggacagcacaagtatacaccaaggcaggcacatgtgtggcataagcatcatggtgaaaccgtttcggtgtccaagacagagttcactaatcagtcacagcaaactcttccctctgagtttgaacacaagtcttagtaaaagcattctaagtcacatcacctaaagaagatacagtgtctaaacagaattatattttcagaactcgttaattttttaaatatatatatatttttattttactttaagttgtagggtacatgtgcacaacgtgcaggtttgttacatatgtatacatgtgccatgttggtgtgctgcacccattaacttgtcatttacattaagtatttctcctaatgctatccctcccccctcccccaactccgtgacaggccccggtgtgtgatgttccgtttcctgtgtccaagtgttctcattgttcagttcccacctatgagtgagaacatgcggtgtttgggtttttgtccttgcgagtttgctgagaatgatggtttccagcttcatccatgtccctacaaaggacatgaactcatcattttttatggctgctggaagacagtgtggcgattcctcaaggatctagaactagaaataccatttgacccagccatcccattactggatatgtacccaaagggtaataaatcatgctgctataaagacacacgcacacatatgtttattgcggcactattcacaatagcaaagacttggaaccaaccccaatgtccatcagtgatagactggattaagaactcgttaatttttaagaagcaagcaccaaatacaaattagtttagtttaaaaagtgggaggtgtttggagggggtcatttaaatgaattttcctagtgtccagctgcttagatgatgttatcaattcagtgtatttaaactttgttattggaagtatgagttccagtcttgcctcttctgggttttatgtgcagtaatgctctccctccaaattttgacaataacccagagcaagcctaggctcaccttttcacagtttaacaacgatagcaaaaacaaacactctttccccggtcattctgataaattcccaggaccatctcattcggacagcttatctcacttgcgccctctagacgtttagatggagtttgcagtttacctctcaaataacctggactaagagcaaaaccctaaccagcattcatccatctaatgggcagctttgatgtataaacttttctgtttagagttttgtgtggattttcactaatgcgcttggcctttcctaagtggacttttcaagtataaattgtctaccctttcttcacaagccatcgtaagcacttcaactcaaaggaaacttttcccaatcctctatgttttctgccccaaaacagtgatgttgaaatcttacaattccgttcctttaatttgcctttgctgctgtgctattcccatgtacacattgcacctccataataatcaagtttattcagaagcaggatttgtgttttattttgggggcctcaacagtgcaaatgatatattctttcctattacattctttcctgtttatttaaaaaccgctgctaacaacacaatagagtcatgtgaaatccttcgttttttgaaacattataataggtgatcatgtaagatttatgagatgaaagctgtattttccagagaaatgcattgagacctttgtaatataaatcatatttggagaataaagaatgtaatagcaagaagagcataatgatttattacatgacagtgatgtttaacctactttagacaccacactgtgtttttccatagtaaaacactgataagggaacagcacattactttagggtattatttggtcaggaataaatgggtaatcagtggattctgagatcacaactagcaagaataatatatatttgttcaataataattttgaagaaaattaatgttaacagacttatatagtagaatagataactttggtgactatgtgctagatccattttaggcatcttacctatatcttattaactctatgcaataatcctagaaatagattttattatttctcaccagttttatagatgagagaaccgtcacagagaggtttactaactttcctaaggtctgattttctttattatggcagtatgtacaatgccaggtttgaagacagcgagttttgtttcagaatctggtctcttaacccttaacacttattctttgaacacgaataagtgatatctaatatcattgagaatggcaattttgctaaaattaagtaccatgtagcatctatcctgataaaagtagtgacttataacagtttaggtggtgtcatttgtaagttaacttcagtccaatgatgaataaagttcaaaatctttttagaaatagcatatgtttgggatattctttgtaaaagcaatgatgagagatattttcaatggaaaacaaattattaaaatcacaaatttttgttttctttctgcatcgaaatatttaacaagtttttcaaataaggtatttcaaaggtgaaacctgtttcaagttgggctttccaaatatgtttgccataaacaaactttcagaactaatttgctgattattgacagaattctgagaaattgtaaatgtcatagtagtgccaaaatatgttaatttgctaatcctataaaggaaaatacaatttttcaaatctcctgtatttcttaagggaaatagataaacttacaggcccataaataatagacatactttaattacatgggtttaaatattccatatagaggctattacaaaagggatcttttgtttgtagtacagttataagaaaacaatgaatatatctccagcttttataaaatgttttttaaagacacatcaattgtgtttgccactaccactacatatacatatgtagaaaatcatttctctttggatttattactaggataatatttatctttttttaagaattaatatacttacttattgttattacagtgatgttatgagtcctctagaagtgaaagatgactgtcagatagagaaggggtggggaaggacagataatatgcatattaatgttagagaattagagaactgaggagtctcactgaagactccagggttggaaaagaagatgagtagacacagaattcaatgatgaagaactctgtgatacggaaggcaggaagaggaataaaatgttggctatttcataggtaagcattggaaacattttaatcctttccattgtttaaaataagtaaatcagataatccagatatagtgttgagtaaatcctagagatgagtgacatgagaccacaggaaaatatttagtcagaaagagaatggagaagctgccacatgaagaaagaccatgactgttaaggtctcatctctcttttaaggggcagatactaagaggagaatatgaaagacaaaaatcaggaagtttatgtttacagaaagtttctgagttttaaaaataggtatgttaaaatttgaaactttaggctgactagcaggaaatattttaaaattttgttggaagaaattttattaaagtttatagtctaagaagttgtacatgtttataattagatatatttatatatctaattatgtatttataatagactgaataatagatatatttatatttctcttttatatataaatatatataagtataatataatagatatatttataatagactgaatacagtcagtctattacttcatagaataaagattagaaggaactgaatatattggaaagaacagtccattagttttgtcatttttttaagagtttcattagcaatcttctaattcaagctgttccaaagaaataggtcgttttcacagttgtcccttttaattttgggaaatgagacaggagagaaggaaaaggaggcgagcaaatttttactcacacttaacactgggctggaagttgtggtcactctgagcacatagagcggattaagggacatttttgctttcaaggagctcagagtctggttctaagagatttttctcaactacccctaatgtaagcgtcttctagattttataatgcttacactcaaaatctatccctctcctaaacaatgaaatagaaaaaaacaaaaattcattgaaatttactactatgtgttgtggctataatttttttctttctccttttcttgtcaaactgtgatatcattacctatatgattgagtttagaataacttttattgagcatttattctaaagtagttattatgctaggttatgatgttataaaaatgtgtatcatctgattcagcgtttggtctcttctaaatcagtgttctgaaacaataccagggactcccaaatcctgaaatctgtgcatttttctcaggcttcctttttctctgtggcttttgaccccattgtccaacccatgctccttaaaattttaacctcatgggctgccctttcattcatctgctttacctctctatttttaccaccgcgtcctttaaatatgaagctcatgaaacctgaggttcctgaggttcctaaagttgcattgtctcttctatttttttaacttttctatttcaattgtcaccatcttaaagactttgatcctacttcttattcattctaaccagtagtcgtttctgatagtagggtttaacccagctttctcatctataaaatgaataggttgatcaggactgccttcattttttttcctctaagttcttttatttgggatctaactccacatctctaaacttcaaccttttcatagacttcaggctaacatttccaaggtatcttgcaactatttaagtgtaacagatttggaagttgaccctccaatccgccacaccgcaagacttcctcctcctcctgagtttctcagttctgccaatgcctctctcccaaacatgcaagcttgacttttgggttcagttctgtctctgttgtcttctttgttgtgttcttttgtccactctgtcaccaagttctgtcttttcccccacctactttttctcatttttaaagtaggaagcatcttttcagatgtatttttttttcttccataatgcctagtgtaaacgttgcacagagtaagtgcttggtaaatatttgttgaatggagtctctcttcttctcttcttgtctgatgcttagtacttgttaagaaatggtgaatcccaattaaagtcaacaaaatgtgaatcagagcaacattctcttttttcgacccatcttaagtacaacattttttctacccatcataagtacaacatttaaaccatctgaaatagaataaactggttagaaaaatagtgttcttctttgagcccctccagaatctgaattcagtgaaaatctgttcaaaccataattctaattaagggttttagctgccaaataatatgttctggttaaagccaagttagtattatggagtgtttcatgaataacagcacaagctttaaacttgctgttgattttctcatgggaaactcaagtaaaggagaatgatacctccctgttgactttaacttttagaaatgcaaagcatgctgaaattgtacataattctcttctaaagaaaaggaaatagcatttcaatggttttcctcagtgtcttattgagttatggtggggcacaattgtgtctgttaaactgatttaccagatggaaggttacattttatatttagctgattaagttgtaagagactggaattgtatctcatactataaaggtcatatataaaattaaaaaatattttgattaactattttgaagcaattaaaaggtttaaactgttccccctcctcttttacttacattaaactaaaaatgaagttattcttagaaataggcctatcacagagttggtatttggcttaataatatctcaaatggaatgtgtaaaacaacagcaacaaaaaaagggaaatactcccattcaagttttggaaattgcttttcttggctatttaatgtattcttagtattttatggttaaattaaataatccttaatttatatacttataccctatggaacttttacagaaatatttaaaggaaataaattatactttttgtcttttttctcttttggatcttctgcaagtaaacaaatacattaataaaacctttaccgtagaaaattaaatgtggcaaagtgctaagtaaatttttgtcctggcatttttgctgtgtgatcatatatcattaatactactctttaattcctactacattacctaaaaataatgcattaaaaatacagcccagtaaaatctgatctagtcagaaccagtatttcagaatattcagacttccaaaatagcaccaatcttggaattcattcaactactgtattattttcctgtggatgctgtaacaaattactgcaaacttagttgcctaaaccaatctatatttattactttacactgctggaggtcatatgtccaaaatggctttgcctgggctaaaatgaaggcatcaccctggcgtgttcttttctggggactctgggaatgaatccctctccttgtttattctggcttccggaggctgcctgcaagctctagctgtgggctgtcccatcctcgtggccactaggaccaaccaagcctttctcaaatggcattgcactgacacttctctgcctccctcttccttattttttaaggaccccttggataatccaagttaatcttttttaagtcagttgattggcaaccttaaatccatttgtaagtttacctttaccacctaatgtgatacagtcacaaattctggggaatagaacatggacatctttggagtggggcattattctgcctaccccaagtgcttagagttttcgttaagatggtgttttctgcagtgtactttgacttactacccctttactattttatgtgaaatttgtttgcgatgcctttatccgggcagtcatccagagaaagttgactaaatagaaggtgtttaactgatgatctgtctagaaaaggattcaggggaggcctgaatgaatctagaggtgaaattttgccttttatatccattcaagataggtaatagtgtttccttataaatatatattataaagagaatgtatgatatagttcagtaaagttataaatgctattgaggtagaattgaattaccaataacgttccaaaaccataaaggttgtctaaaggttataaaatcaaaacttgcaaagcaaaataaataataacagatgcccaggtgacttggaaggttctgaaacaggacaagagcaggaagcaaagtggtatttgaactggggagaggacagtctcctgttggccagaagtcactgctgaccccttgtcagtggtgctgctgatccatggtacctgaatgtatctgaggggctgtgaagagttgaatagacttagaggttacacctaaagacttaaaattatattgtgagagataacaattattagtaacagtaattagacgtttaaaaaatgtacgtgcatctctttattaagctgaacaatgtgattccctaaagaaataaatggaaccatgttctgtccagaaatctcagaaccacaccaggtgcctagttttcctttatttcatccagtactaacttctgttattgcttgctgttaaatctcccctttcttatcgtgcctactgttttagttcattccctattttgttcagcctccattccagttattaaccactgattccatcatactcctgtccagtcaatcctttgactttctaaagtttaagtctagtcttcctaccctctaaaagagccatttactgcctcttctgttatgtacaaggctaaagctcctccatcgcaagcatgatctctgtctccttattccctctctgacctctctcaactctccccagtccactacctcatacccctttgccctagcagtaatgaaaaaattgaaattccatgaacaaatctttctgtttcccattcacacaagccattctcatctggttttccagatgctccttgctcttaaagtgccctcttcaatagttcatactcatctttaaatgctcagatgatatatatacttcctctctgttaagctttacctggtaccttcctacccaccaggccaccccagatagtcacttcatattttatgccaaatgtatatgcccaaatatgccctgacatatctctgtgcatatatctctatattaaaattacattctactcagttgaggaatccttgaggacagtatctttagcctatttattattgtatccccagcatcttcagagagctcataattggcactgaataaatttctgttatatgagtaaatgaatatatgcactaaaataggaactaatacacatttatttgggtatttaaaattctagaagttgttttgctaaataatttttaagaatttaatttgcaataacattttggaggtaggagactaactgcttccggatgactgtaactgggtaaatcagaagaaaacaaggaaacaaaatttttcatgttagcaagttgatgttatagtcttttaaatattattttattttaattcttgtggaatgaaatgacttgctagaggatgattttgcaatttaatgggaattggctaaaaattttcagataaacatcagagagacaaaaacctaaagtaatatatttgaagaagataattgtatggcatttcaaattagacagtgatttactatacttattgtagtcaatgtattccatttattacttctgaactctttaaggtcaggaatggctgttattgtccacatttgcaggcaagaaaattgaagcacagcgacattaaatattttactcagatgttatggtggtagagtcaagactggaaaacaactccagactcttaggagggtaacaagatgaggttcatgctgagagaaccaataagtacaataaagtttaggtttatgatgatacccaggatattatcaggggataggtattgcctttctggaccatgaaatcctgacctataacgttttctgggagtaattccatgctgtctccatgtgtgtccctatcaagcactgggatgcaccctaaatagatctcacctactaaaatggccccactctctcacgcagtcagttcacatgtagctcttatgaactgtctgagtaggagggacattaaaacattatatatccacaataaaattacttttcatgccatttctatttgaatggtatataaaagatatatctagtacagaattttgtatatatatatatatatatatatatatatatatatgtaggaattcgtttgttacagaaagattcatagcagaataattacacagaattttagagtgaacaggacttgtttacaagaaaaaatacataaacacatgtatgaattcagatttcccccaaagtagcatgttatttgtgaaataccaattcagaagtatactttataataaaactttgggattcaggtagaaaagaaaattattttagaaactggattgaagactgaaacatgtttataatctagttcgatttattgaaatgataattcaaaatgatgctagatagatttttaaatttgtcttaggtaaataaaatatatttgaaaaattaaagcatataaaggagttagcatatgaaggcattctggcctgtatgagatatggatttccttgactccaaaatgtagtatttgtgatgcttgccagaaaagagaaattccttctgcattccacatctgatctatgagacctcttgccatgacattcagcatcaagaaattcttagaaattagggtagttgaggttcatctagttctcttctcaacaatatttgagactcagccttttaatgtaagtttccttcatgcttggatgtatacaggcatgtattattcattcagcaactgtttatggagacccatcgagcctatgttcttgctaagtactggaaatagacacaagatcaatgattacattatatttctgctaagcatcaagggctggagccatattgcagtgttttgaggttaggaagtggtagtggcaagtataggctatttctttaacttgactatgaaagtgcaatcacaggaagtagctcataagatctgtgtctatgggggcttatttttatttgaatgggaaatatttgagcctgtctacattctgagaaggagccagaagagagagggaatttgaagatacatgttgcataacctctataagtatctcatagattaactaaaatgtgtttgatatttatctttgaagttttattttttatttagtattccttccctcaccagcatacttaatctccattctttgaatgtgtgggctctgtgcccttggacgtggttatttcctctgcatagaactgcacttctcccacctttacctgtcaacatctcactaagccctggaggatcctctttcaaagcaaatgaatgtctgcctttcagccacaacactctgcttatacctatcacgtggcactgatcccagttagtatattattcattcttgagaccatgagcacctaggagaaaaagactctctgtcttttctctgggggagttgcctcagcacttaacatgcactttttcccattccttgattccttgtttgaataaatagctaaaggatttattccatgtagttggcactgtataggtacctgaacaatgaaaatatggctacacatgcttccagtctgcatgaaacttgcaaccttgtttctcaatattattattcaatagctgttaatcgaatgtaattaaacaatagatctaattaaatagtaggttttaattttaactataaaataattagaattttataacttactattaaaatttatttttaaactgaatcacactgattaaagtatttttatgttaaaaatgataatttgttaaaatgtcataaaaattttaggaagttattttttcctgtttgtcctagtattaaaaaaacagtaatgagtagtactaaaagtagtactaaaaaccagtgttactactgagtggtactttttttttttttttaatactagaacaaacaggaaaaaatagcaaatttgtacattcattcattcactccgtaaacttttactgagtttcacctgagccagccgagtgccaggcactcttgaggcacattggtgaggaggaggaaaagtgctgctcttagagggaactgagtgcactgtcatgagctttagatgctaaggaaaaatgcccacctttccccttctagaccatgctcctgttacttacggccccgatattgtcttcccatcctactctgcgatgcttccaatgacttggtagttctctttcccatgtatgaccattttttttcccgatatgtaaagaggttatcattgttgtttccatctgtgataaacgttaagaattaaatttctatttacattgatagaaggaaatacaacttcctagaaaactcacacaatgatgtacataacagtgctgtctttcgaagcaaaacaatgtgtagtacacccaagtgtccaacattgtcttattcttaagtgaaatattgtgtattcacatgtaagtgtggatatataatatatagtatatcctcataatgtatttttaaaagaatatataattgcttggggaaaaacataatagatttttaagtgaaaaacataataaatgcaataattttaaggaatacgtaattacctgggaaaagacccataatatattattaaatgaacaaataagatataatcataaatataatgattctcattttcaaataattttacctacataacacaaagggaacattttagagtatacacaaattttcccattcttaaaaatctcaaatatgtatgacttacataatcggaagcaagcaataaaatttattataaaattagcacttttcaaaagatcatattgtaaattgattaacatttacaaatatggattttgaaaaatggtaatcttaacaagtagacaaaattggtatatttgcaataagagaatggatagatgcagtagtatttctcaaaaacaaatagtattataatgtctttaggaaattgcattcatgtattaccatacatgtgcctagaaattcccccaaaattattttttgaaaactttatatatgaattacatactgttaagtggttataattagaaatagttacattagaaattttgctccttagtgtcaaaatatataaaatctaattcataacattaaaggttcattttatcccagccagaagaggcatacattgtattatttattgtagtatgccaagtagtacttttgaaaatatgtaccttttgtataattatgaaacttttaattagagtaacctgtgtattttgattaactagactggaggatctactgtgttcccaaagtgtctttcataactgtagtgattactgatttgaacagtttctagatttctacaatgccagcctgggttataggagagatttgggcaggaactgtgccaggaaatctaaccttcagaaagaacagagagtgaatgaataggtgatagattataataagtatttggttccaagtaacaaaacatttaaatatggcagctcctaagggatccctgagaggaggagatagcaggagaaacccaggggagggagaaactgtgtggagaagttgacagatatccagtactgcagggaagaatagacaatgccagaaagggatctgaagctggtggtgaagacttgaccttcacctatgattacagagctaaatgttcactacaggtggaatcattgtatatcccaaatattcattattttaaaaacatgtatgtatgtatttatttatttagagagggagtctcgccctgtcacccaggctggagtgcaatggcatgatctcgactcactgcaacatctgcctcccaggttcaagcaattctgctgcctcagctcccaagtagctgggattacagggacgtgccaccacacccggctaattttttgtatttttaatagagatgggttttcaccatgttggacaggctggtctcaaattcctgacttcatgatctgcccgccttggcctcccagagtgctgggattacgggtgtgagccaccgtgcccggcctaaagaaacatttattaatctagtactcaatcttggttaataattaatcatcttaatatatgaaatatgttaaaatatttatataatattaacacaatggaaaattttccattttttccttatgataattttcaataagaatgaagaacttctacataccacacaatgtggtattgaaattttttaatctaaattattgttgtaaagaatattcacaacctaggattaagagtgaacagaggccgggtacagtggctcacatctgtaatcccagcactttgggaggccaaggcaagcagaacgcttgagcccaggaatttgagaccagcttggacaatgtggcaaaaccccatctgtataaaaaatacaaaaattagctgggtttggtggcatgtgcctatggtcccagctacccaggaggctgaggtaggaggatctcttgagcccaggaagttgaggctgtagtgagctgagatcatcccactgcactccagcctgggtgacagagtgagacccggtctctggaaaaaaaaaaaaaaaagtgagcagaggcaaaatacacatagtaggtggtccttcttaagtggatgatgatctagttaagacttagaactaaacagaatacaatttataagcaggcaaattagaaagtgagaaaaatatgtgaagtcagttattaaccaaaagttattttaagtacactgagtcaaagttcagaaaagggctattgttatggttatggtgttttcaaacattacactaggcaaaggagtgtaccaattgcagccatctctctctctacttattttttattttgtttaattttaacataacttcatcttacatctgcacttcatgaaacattcattcaacatctatgtaatgaacaattttttttttatgatagacaaccaggtgagccaagaaccaggatgtgtggtaggcattgttaccattcttttgtagatgataaaatgattcacagagatgaaatcactcatttggggttacagttagtacatcaaagagttagcattggtggctgggtgcagtggctcacgcttgtaatcccaacactttggcaggccaaggcgggcggattacaaggtcaggagctccagaccacccttgccaacatggtgaaaccctgtctccactaaaaatacaaaaattagccaggtgtggtggcacgcccctataatcccagctacttgggaggctgaggcagaattgcttgaacccaggagggggaggttacagtgagccaagatcacggcactgcattccagcatgggcgacagagcaagactccattgcagggggggtaaaaaaagcattgggatgagaggtctggtctatttgtgtcagagtcctgtgtgcttctacacaagatagtttgtgtgcctgtctgcatgcatgtgtatacaaaaatcacgccccgcaattatgtacacagtcacacatatcaatctcttagtaaaatgacaagtctgggcagtgtcactcactgtaccttggaatcctaattttttaacctttgcttccgccacctaggtttactattcctctcccatgttttattctcatacctgccaccctaagtttattgtgtaccatggagactagtatgagaatgaagatttgaaatacctttagttcatgaggcattcttcagatattttctgtttccttttattgaggatattttcttttaggtgagaagagaaaaaggtattgggtctgttctgttttactattgattgttttcacttaaataatgatagccaatttttatacaaagttttcatctcagcaggcaaatgtattcagatgagcacacacactaaaaagcttgccttctgtttctatgattaattgagatgtagagaatgatgggtgtggggtaaaaatggaaaggtaattagtgtaactaggcatgaaatacattcatatacaagcagaacctctccccagctagtgatctttttctgggctctgaggatttgcatcccattagtaagtcactggcatggaaatcttcagcctttggggagaccagagcattaaaaatagaattaactctaactgcaaacggagtcagcacactaggccattaattcttctgcttgggtatatatcatgctgagcttctgtgtgtgggcttctgaaatgttaggagtgagttttatagagcattgccaggactaaatgatagttatctatcatctcatctctcaccctcactactgagattttaatatctctcatgacccaaaacctgaaatacaggcagaaggttttgctagaaacattaagtaggggcctttctttagagaagttgtatactgtatattttgttaacataaatctatgttgtgctttacagtatgtcagagattccttattttcaaaaccttatgtcctcagatcatcacaatgcctcaaatgttatcctttctaaaactgagaattatgcctttttgcataactccaccaactaatgataaaagttgcctagtgttattatttttagaaatattagtggtattggaaacattttaaaatcaacttccaagtataaaatttattgaaacatttaatatatacaagctacatagagtactctcaatttctaataatctctcttttcttttcttcccttacccttctccagcttctttgggaatctctgacagatattattttctttagtcatcccagagcagtacaattattaacagctgccattgactgattgcctgtcccagggtttctcatacttcgcactattaacatttgggtaaagataatactttgtcatgggatgctgtcctgtgctttgtaggatgtttggcagtacccctggcctgtacccataccagatgcctgtagcagctctccatactgatgaccaaaaatgtgtccagatattgccaaatgtcccctggaagagaaatcttccctggttgtgaaccactggcctattctctactagtcactatttcatttgatcctatagtagctgcaagatatgtgggactggctgggtgcagtggctcacacctgtaatcccagcactttgggaggccgaggcgagtggatcacctgaggtcaggagttcgagaccatcctggccaacatggtgaaaccctgtctttactaagaatacaaaattagccaggcatggtggcacatgcctgtagtctcagctacctgggaggctgaggcaggagaatctctggaacccaggaggcggaggttgcagcagtgagccaagatcgtaccactacactccagcctgggcaacagagcgagactccatctcaaaaaaaaaaaaaaaaaaaaaaaaaaaagatatgtaggactatattaatcaggatcctggcagggaacagatctttgcagcgtgggtcatagacttttatgaagggactacttaacaaggaagttagtaaggttaaatgaactgcttagggaagtgggggtacccagaaaatagcaatagtgggaggtcattcccacaaagaagagaggggaggaaatttttcctggagtgctggagagctggagccctggaatagtggcttccagagggagatgaagtcaggaagagacatagccatggccagttatgcagcactgtgacagggagagtgtaggacagcctggcctctccctcctccttaattctttggccaccagcctgtcctgccagtagattaagcccaagtgaaatccaaccagcaaagaactagagtgttgcagctccaggattcagcccccatgggcttagagaaggaaggacaattgaatctgttggggggaaaatgaagaaaatccctccaacatccccattttaacatgagaaatcgaggtttaatgatataaagtaattcatccaggcatctatttgactccaggcacaatgaaggtatcatcttagttggtctgtgtgaatgaactgatgttcagcaagactgtgaattattcaaggttactgattttagtaggtggtagatacaagactaaaacccagttctcattcctcttctggtgtttgcttttttatgttgaccattgaaagaaatctgagagctctatatctggctgattctcaagtagacaaacaggagtgaaagctatctgctgaccttaaaaatcatttctttctgaaaatcttggaaaattctaggtttcatctagaatgtttaaatggcatatgctatttttccaatctgtcagcacatttttatcttgattgcagacactcagccccagctgatgcaatatattaggagagggaggaggacaagactgagaataaggagatttggggcccagttctggatcagcccctcttagctgtataactagccttcagaaatagtaccaataatatgtttcataaacccttcccttctacattcacccagatcttcacagttattctcaggtatctaattggaaaggctttaagctatgtttcacaaatgaagaatcaggcttagaaagcactataatctcactgcaaatttcataacaggaaagttgtcccatgcagactgaattcacatccctcaatgaaaatgcatggtcttttctagtccacccactgccttttgaagtgatcaattgatttactccctatggactgccagtttgcagcatttaatccattaggttgcattataaaatcatatctccatctaagttctgagaatctatgatttcctatggttattagcaaggctacagaggataccaatgtagttagcacctagggattcatggttctttatttttcctttctaggttttagataaatatatttattatctataactttttggaggcaagatcaatatttttgaagtaatttaaaaatacatgtgtacatgaaaacatatctaagtacattaatacagtcccagtatctcactttattcctgggtaagttgggggttagaaactgagatagattcctacactaaggtgaagtgtgttgccactactggaagatctggcaagaatcctaatcctttcccaaattggttggtttgtttgccttcatgtgggagtcccggcaagtgatacatttcagatctctatcactttgagcttgtgctcacccctgatctctgccccaccttttgacaccctacttttacagcattttcgggcttttggtttttttatcttttcagtattttcaagcataaaatcaggtttacaatacaaaaaaagtagctttattttttgtatctgaacttcatttttaagttcctatttcaccaagccaattccaagaaaacatataatgcaagagttctccatcgaagcttaaagcaaaaagtatagatatttgaagactaaaacaacaaaaaaagtggagaagaattgtaagttctacctttgatatcccttgtggtctgtcaaaaatataaattccctcaaaaatattttcactgataaaatctggctacattataacattgtgtctgctctagatgattagtggtgctttgggaaaaactattttataatttttatgatgataatacataaggaaagctggaagagcaacattttcagtatttagaatagacttatgccagactacctgggtacagagcctggcttcatctccttttacctctgtaaccttgggcaagatacttaccctgtctgtctgttttggtttcctcattgatctaatcaaattataaataggcataggctttccagatgtttttatggttaaacaagttgatattgataaaacatttagaatagtactggaacataaaaaagactatataaatgttaattgttatgagaaatatccttttcatgatgatcattaccaccaccatcaccaccatccacttctgctgcacagagatgcaatccaatgtttccattcttctaaagtataattattttgaaataagtggtattattttaaaaatagtgaagctctgtaataagcttcactgtttagaatatgaaataaatggtaacatacatgtgaataatgtgcatttgtattatggaatatataacctaactcagaaccttcaattcgaagacttagccaccttttctttccagctgatagtatactgcatgtatagaatgtcttatttgcattgattctagttggtttggtgtcattacactgagtatgtttccccaaggttttagattagaaactactgacaaagaaatattccaggagtcagaattagacataaattatatgctgcagaggtgtcttcttattaccacaagccaggtcagagtctctaaaatcacattcagttactcttttagtggttattaagtttcacccttgagagaattaagaggcctgacaatgaagtataataaatcttactgtgacccaaacacaattagtaattaaacttcccattaacaatcccaaatctgctagataaaataagtagaaaacttatatttttgtttactttttactttcatatttagagaagttgaaaaaagtttcacagatttcataaaaataattgcaatatttgcctgtttcattaatgtagagtcaatgcctcatttatgtgcttgggtttttcatttgagaatgagaatggaccaagaaaagggtgagactttttttttttttaacacatgagcaattggctctctatttttttaatttttatctatttttttttttttgtctcaatccccagcctctgagcccaacttgaaggtgcggtccaggttaaaacagaaagtggcagagaggagaagcagccccttactcaggcggaaggatggaaatgttgtcacttcattcaagaagcgaatgtttgaggtgacaggtaattgaggactgggcagacctatgaatgctgggagtaggaatgaaaaaaaaatagtttagaataaatatacctgctgcatattaaaagttattttgagaagaaatatttcttgaaaggaaattatattgaaaactcacaagtagttcaataaaccttgctatgcattcaccaactgtgttaaacaggaaatgaatgaaaaaacagaagtatgtgtcaatcaaggcataactagggaacaccaaagctcaccttattcttttcaggaacaggcagtccattttgggaatgccaaccaggagaatataatttttaatgaaatttgatcagaaatgagcagagggaggtccaagaagaacactttcccctgtactcagacatgaatgtacaaaatacatctgggaaaattaaactacatggaacagcaaaaccttgacttttcaacaaatttacagaactcataaatgactttatgtgtttactagtgaagtgggacttatggcaggagggggatatattgctttttatgaaggggaagaaactgtcattttcatgggtctcaaatggaagagttatttttttagctgcctgttttagtagaggggttaggaaattcaacctgaggtcttacaacacccctagttccagttgtacctggtttgaaatgaaagacctaaggctgtaagaaccaaaaatactagccaaaatacttctacttactactgttttttgagtacctacttagagtcaggtactgtatctagttgtttcctttggttgcatgaagaaagaagtggtaatctgcaaccccttttttttcccattctcaaggaaaactgtgcttataccaatgtgggcagttggtattagttctccaagatcagatcttatttttagtaagttttaaaaaaattctttattttctgtataactcttttggccatgacagtgtctacaggaaggcaatatagaggaagactgtggaagtggtggtagaaacgtgtatttaggttctaatgcaacctgaaagtttggccgataatttttggaaaataatatttagtctcctattcaatctggacaactttatatgcttatctgaagaaaagtgttagtgatttcaatggaaagtatttccttgggataagaaatattaaatctgaataataaatacaattattttactagagtttatatgtattatccaacattaaatataatcactaatttagacgaattgaattctaagtttggagttacagacttttttcccaggaaatactattgtatgtaagtaaataaaaatcttaggtttttctaatagaggtctttgatgggggtgggcagttgaggagtgaatttgttttaatgaatgtgaagaattataaacctatcaggtgtctaatgtaaatgtagataggtggtttttctaactgcagaaagtaagccccttctaacagcaaaacttctagaaaagacaaaactgaatataatgctattttattttgcttcatagtcttaatgtctgaagtcatatttatttatcccaatgtgcttttctgtgttcctgtagtctgttttcttgatcatagctttttctacacagtcactttttcttccgtaccaaattgcagtggcatttagctcaatacctatctcagtaatgattggttcttatttataaggattatgatttaccagagttttactcgaatttccttaaatttaaaatatatttctcttcttaatttcgtgagataagcactcgccctttcacctcaggaaacaatatgtattggaagagagacttgtacatttattagaaagacatttctggtgagtggacttacggatgctttggtagatatttttaactggtataccgcacttactcgaaatgtctttggaggctccggactactgacacacagctgtcttcacctgtactccttcccattgctctgccaactttcatctagtttggatgagatttgtttggatcttaatactaaatatttttagtatctagtcagagactatcataacatcagagcagttcagttgcttttgctgttatcctcttacctctatgtcttttctctcttccccatttcatagattaaagtgtaagctcttttcaaactcattccactcattgacatgggaacccacttgccatctttttttttcaaattcaagtattttctgccccctacaaaaagtcctgttcttttcaaatgttaaaattgactccccctgtgcctgcaatgccttctctgccattctccctactccaacatccttatttcattggctacccttcttcaagctccagttccaatatcatacactgagatcagagatctcagaaaatcagttgctatcttctcccagatcccatccagtgtcatgtcatagaatcctctggtacagtagttgttgccctgaattctagtgcttatcacagtgatttctacataaggaaatacttcagtcttaatatcataaaataatataaatattataatttaaaattggtaagacagaatgtttaagaaagtagtttttaaaaaatatggaaatggaaatgatatggaaatgagacattaatgagaaatcagtcatattgtaaagacgagagttaggagttgggaaaaagaagctcctgtaagaatttttaaattctacatttcctttgttaaagtaaaaccagaggtgatgattaaaaaaaattaatcaaaatataaaccagatatatagacagaaaggcagtgagcaaaatgtgtttaagtattttattatactaataatttgctcaaatcccacagtaaataagtggcaggattagaattcttacattaacctcacattctttccagtggtactgcatttctgagtagagatttaattataatacaagttgagagttataggtgttctgagagagggtaagaaaatattgcttggaaactgggtgttccctttctctgagggacatacgttatatgagccaggcttggaccttataggtgggattcggcctgcaatgaaatggaaagaaaggaggatacaaaagcatgaactggaaaagtatttggcatgaaaggagaataggtgatttaatttgactgagtgtagagtacagaaagggcaatggtgggaaataatattaggctctattttggagcagagggacatggtgtgagttatctctgtctgatccttttgcaagagtttgaaagaaaggtttgagagactactgtagtgactcagaaatatgagcagacttttgctatagttcttgacagaataacaaggccttaaactgaaatgattgtagtcagacatagatggagagatagtgtaaagatcacattaaaagggcctagtaactaattagatttgcagtaaagagagagtgaggatgactctagggtgatgaaaaaatagagatatgcaggaaacagttaatattaaaatacatacattgagttttacacatatgtaggggagcttggaaggtccagctttcagaggaatttgggctggaatttatgagttaaaggcaagaaatgtgactttcctgagataattctgccccaaaatgacatatgaagtcatgatactgagtgattttgacaagggaaatagaaaagggataaagtcacaaacttaggtgaatgtctgaatttaggaattggtaggaggaagaaaagtcaaagagatgggaagacaaacatggatgtagagaatgccactgtagaaaggatgtggaaaggaatgttttctctgaggccttcaagtgtggtggcatttgagagaacagttgcagttaatagtgggtaagctatattgccaaggcttgaagaagtgagtggacattgtgagagcacaccatttctcaagaattactagcatgctgtcagactagaggggcaattccagtgtaggaggagggcctgaagattccacctaactaatccttttaggatttttttaaggggatgggatcatgggtaagactaaatgtgtgagcgttagagaggaagagaaatgccttatatttgaaatgggaaaagagaatgtagataacataatcatgagtagaaagaaaagatgctggtggaaatcatatcaaaaatcctgtctctgaaaagcatgaggcaagatcatttgtgcagagttgggttgacaaggtgtaatgatgaggcagctaggaagattttgaaatgagtgaagtgtagaaggtggtagggaattaattagagctgaataaataatttgccaaagcttgataagatgacttctctagctatatttctaggaaatggaaatttatatttttgattaaatgttttaataaatgcattagtttctgcataagttgaggtacatgtgaatttcatatctgaagaggaaaggatgggttaaataaagaatctgtcttgttgttgcctgacttttgctaaaaggaatttcttgttatattggtatttacaaatctacatgttaaatttaggcaacttctcattttctggaaaataagttgagtagagttaaagtcagatggtcttgtacaaggtcatcagtgcaatgttgagattttacattctattgtattttcttcatataacttgaactagtatatgcaataataaggtatagccttagtatattaaataaaaaacaatttacagcacagcatttgaacaatttttttcagacctaatggaatgggtctgaacctcatgggttaacgacttgtcttttgatgtgcacaagttcattgtcttcattactgttattttctgtaatagcataagagcaagtaagaaaagattcctttcttcagttttttttttttttctcattcaaagctcctgtgaccctctctaactggatatctttacttctctagaaactgttgaacactatttagtatgttttgccatgaaaacaaaggaggaataagtggtatgaaaattcagagttactgcagaaatttttagttctttctattttgtgaaatagtgcttgcatttacatagggggaaaataacatgcccaatgttacatgttacagtaactaaagttcatctatgtatgttcctcatgaacacatttgtacttcacaatatttttcagaatcctcagtcagtagcagttctccaggctctggtcccagttcaccaaacaatgggccaactggaagtgttactgaaaatgagacttcggttttgccccctacccctcatgccgaggtaagacccttattattttgtttcttttaaaaactgaatttctgattagctacctaatacaaagtgatatttctgagttgaccttcaatatccaaatgatatttatgaattgaagtttactcagttccacatattgtaaaccaattgaaaaaaattgatatttactaactaatgtaaatattataaacctataagaaatgaactgatatttattagctgacataaataaatatcaatttttttcttacagattttttcttatttatggaattcagtaaaattgatcttatttataaatcagacaaccaaagatgtttggaaggcaatctgggcttgaaatgtaatcctcagtcaaacattcttagtgatcctccgtgcacactgcctgacaattatgtaacttactagtccctctgcttggttattggttgtgccgatgtgagtagacacatcagtaagtaaaaacaactcgtacaggcctctcagaggaagaacctagcgaggtggatttttatccatttgaactgaaaagtgatgaaaaataattgcagtattatagttgaagggtgtgaagcttcactgagcaaacattttttgagcacctgctatattcaagtcattttgcctcacagtagggatataaacatggacaagatatgaactctatgtttgaagaatgacatattaaaggatattagtttaaagtaacacatgatttagtgtaaccaatgatacaagactaagaggaaagttaatgtaaaagtcagcaagaatttgtctatgtagtttctgtataaggctatcaaaggcaagagtctgaaaatagccactcatgaaatcacctgttttgaagtcatcaacaattgactgaaagccttatttttgtttctgttattatgccttcttcactgtgcattgctctgtgcaaggagagctggtgcgttaacttctaatatataacatacttcttttgttatattttatagagtcatggtaccttgagacagaaagggactggtcaagtctcttattcttggatcatctccatagcttttctaccatgtggttatccagcctctgttagaacacttctgcttatagggagctcacttcactgtctcctgaggcaacccagttgattttaaatagttattttgactgatatgtctctgtacagctattgctctgtaatttcatatattttatacacacaaacacaatatgatatgtataataaattatttataagttatgaaattatcaggtcagaatataataagtgaaggcagaaatccagaagttgtctctgatgagcaaaggactgaagccagtaaagtcagttttgctctaggcacatttgcacacttgagttttgagctttggttttcagggcctcagaaactcaagagatagaagataaagcctagtaccaaccagggaggataatctaataggagatcctgcaaacactaagctgacaccccagaggcctgtatctatgttacattgattagttgactgcccctcttactgctgtgtcccctgccagccccccctgccctgggctgtctgatgtggaacagagcagagggcagatcctctctctcagatgtcgtaaccacaagctagtccttgtgtagatctgtagcccaaatcatataacctcaagctgttaacttgacttatcatggcaccacatttgtagttcccacgttaggagtctgcacaaagcaaacaaaaactcccctggaggaatataccttccttctagatttcaaaaatttccctcaaataagtttccaagaaacatgagcaaaatatctagatgctgtcgtttgaccattttcagctatttaaagaatagtaattctggcctctacatggtcttcaggtcccgcatctatttcttacttactatcctgttacccctctttatctttttctttatcctttcaaaaacatgatagcagatggaataaatactttgtttatatttgcagccagagacataagtggagttattgggttattagttgtagatagcatctttttgttagtgcagttatatctggatattggtccattctctgcaactatttagtaaatttccaggaaaagaacaacttggttacaattttttttttcaaaaaattttagattgttgttatctctcagtatgaagagtgtaattcttagtaactgcaaaaacagcaaaggatctgggttctaatcagtccctggatggattttgtgccattgaaaaatgaaaacaacacactagactacattcagcagcatgtatgattctgagaaatgcattgtcattgcaatgtttcagaagaccacttacaacatgggaggattttattaggttcagaaatggtaataccatactttgataatatgtagtaatagtatatttttaagaggcgagagagtgatgaacacaaaatttagcatgatgattacctttcaggggggaagaagggggaaaacatgatttgatagttactaaagaagatacatatattccttcattgtaaatacatatgtatgtgcatatagtatttagtacaacatattggaacaaccagtaagtatacatcagtgaagaaagtaaataaaagattttgcttatactgttttaatctgttttatatttctaaagccataacttggcacaaatcatctgtttaggtaccctagcttttcagctaattgttgaacatattctctcactgcaaacctttcctttcacccccaccattaaaaaaagaaaaacaaaacaaaacagagggaaatgtgatttaatggagtttaaaagggtagaggtatttcttcaggtcagtgacaggacattcacctccaaatctggaaagacgagttcaaaagcaagcagtgacttacctcataatgaattaattgtgtgcctgaactatgatccaaaaggccaggtgggcagacctttatgcactgatgagtagcctctctgtggcccagaacaaaaaatgcaaccctgatggctaacatgtggttttctgctgtattgcatttacagagatctatggtgtaattcattctcgataggtgaggagacagcggaatttagactaagactgtcagcaaattaatatcctagctttttagcactaaatgtttccacccaaactggagaaaagaaaaaaaaaatttcttagccatagttgagtaaccatcatttagaatttaggatgatttttacagatgtctcctaagattgatagtagtacgggatttcatagcaacaaatattttgggggtatgaattatttgcataatatattgcactctaaaaaaatggttgcatactttaccgtttacaaaattggcttattttactgtttttgcttaagcaacactggtaagttttcgtattaaagtagtgtatatttgaatgaagtctttattttatggcctgtaagtagaaaagcatgtcacctaattcagagcccatgtaaatgaatgggattctatcctattgtgctgcttcagaagtaggaaagtcaggctatatctaaagatcttgagccctagatgaaaacaaaattttctatcttgtaattcacatgtcctgcctaatttagataaagggaagacagaagtaggaggagaatttactcataaattgaggttcaggaaatagcacattgtagtagaatgtatgggtgttccattcagaagactcagcctgaacctggctccaaaaccggctaccttgtcatcattggtcaagttgtcagacttcccctgacccccagattcctgatctaggagaaggtagtaccgtaatacctacactagcagctttgttttaaggaatcagtgtttggaaggcaggtggtaaattgtgaagttcggaacaagttcattttttgttgttattatcagcgctgactcctggtagggaaaactcattagcatgtttgtcttcaagccagcagctctcatgtgagagtgagtctccatctgctctgaccacttctgttccatttcttctatttcctacatatgctcagtcccagaactcagattgttggagctacttgctttactcatttgtaaacttggttggggagctgaaacctcaggggtttctatttccaactccagtcaaggatgtctttacctatctagttactttattgttaatactgtgggcctgtgggttcaaatatgtttccatggatatcaacactattactttagattcagtagatttatttgatagctattttaacggtagccaagctgctggtttatttctagttgaacattagtggctgtctctgctatgctattttttaaaataaattttccagcagatacaaatgcttttaaaaaaggattctaataataaggttaagtgttctaaaatcatctgtaatgtcacttgttttgccccaatctcacatgactcatctgcctgttgtttcataatagttgttgtgacatttgcagtaaatgttatgctcccttctgagtgggtgtagagctgtggttttagatagcagcaaataaaacacgttccccccacccccaattcagggaaaggaggttgctatgacaaaataatcatttactaggaataacatgagtcaatattttaaagtaagatctttaacaaaacatcagtgcctttcaaatgctaaggaaactctgtcaaatgatctttctttttttgttttttgttttttgttttttggtctcacaatatgtctcaccattttatagtaacaccttctttggtgtccagtaaaatgaaaacttgagagatttctactgcttcaacaatttttttaattacgtggagattttaattttctatgagctatctgaaagaagagtagaaaataaatacaatcttgaaaaatcccatgaaaaccataggcaaatattaaatgattgaggcttttcttttttaaaacgtggctatgttctttttagatagcctggattcagggacttgggaccttgtaaagccaaagctgattgacactcataaggatgtcttcctgtatgccattctaatagacacacatgttacctgatagagctgggcagaggtgcttcagtctcaggctgaaggttctgaagtccagggaagttgggtgctgcccagggttacaagctatgagtgggagagctcaagtataagacacttaggccagacttcgtttcacaagtccaggctgctcctcaccaaaattctgtgtgtatatatatattttttctttttctgattctcatgcatattgtagataatttggaatatacagtaaactgaaaattctatatccacatttctgtgagctttttaaaatgtgagtgattactggccaggcatgggggctcacatctataatctcagcaattcgggaggctgaggtgggaggataacttgaggcctggagtttaagacgagcctgggcaacatagaaagaccctgtctctacagggagaaaaaaaaaaacctaacaaacattagccaggagtttgagcccaagagtttgaagttacagtgggccttgatcgcaccactgcactgcagcctgggcgacagagcaagatcctgtcttaaaaaaaaaaaaaaaaaaaaaaaaaaaaaggaaaagtaggtaattatttacataactagtataactagcattctgtcaagggctatcattgacttttttgtcttcttaagagtaagaaaagtatttgtttatcttcttctctttcccttcctccttttttccctgcctccctccctccttccttggttccttctctccatctcctttccccactttcattttccttgctcctggaggcatcattctctcccgtgttcttgtttatatgaatttttacatcatatatattttttactttgcatccatgagttttaatgggatataaatggcacaatgttatctgcatcattccattttcttgcttttatcactaagcctgtgtttttacatccagacaccatgtctttatggatgcagaagtccaatggtgtgctttcaatcaccacaaaaatccatcgtgggtgctgccgcgtactgatgccccgaggtagatgtcctggtgcccttcaatatataccatggcccatcatcctacagcttaatgagataatttctcgaagttagaattcccagcaaagccatcactgggtcatggtatacagaataattattttggtttaaagttcagcagaattgctgtaccagactactgtcccaccagcatcatatgagagtttttacctttctgaatccctgtggcagttgacattgtccatttttctaattatacccagtgtcccttctggaagacattctcactcttttaattgaaatcagtggcttaatttaaattccacataaatagctctattgagaggcataatgttccagtccatgtgttttgtattcatttgaattacaaatattatttatgagatgcccctcctattgacataacaggagagaaattaaataagattttgaagagccttagtaaaatgtgagtaggccacccctaccccagcacttggcccatttcatatctcatgtcccaacataatgctccttcctctaattacagtaattatcacaagtcaaagaattagctctttacttttctgtgcacctaactaccatgtgaattggtgttttataggacatctttgtacgccttgcacccaacaccattaatctaagacagagaagttacccgttaattgttttgtgaaggttaaacaatagccattcatacatttactatattcattttatctaaccacaataaaaatctttggttctgaaaaattttcagattaaaaccgtcatttccatgttctaaactgcaaagtattggcatcatagcaaagcactgatttaagggctgggccagattcaaaacttcttcttggaaaaatcttggctttgtctgaaaacacttgtgagctcactgcaatgctaaggtgggatggtcttccagccttgcaagaatgctagtcaggatctttcattgtgtcaggtgaatggtacccctcccaatctgttagtctgactttaaagtgtgtctgtactcaattagcagtgtagactatggctccaggtcttattaagagataaacgtggaacagatagactgctccgatcaaaaagcatagttgaggaaagctgtatttaaagaaaataattcaagggaaatggtttttcatttctctgaagtcatcctagaccttgaaagtctacataaatgctatgcctgtttccttatctgtaatccaaggagataagctaagcaatgtcccggtctgtaaagtttctatgaagacgacataccagttaagagtctttgggaagaaccaactatacctagtagatatgggggacacagaaccatccttgcttcatcaagaattgtctccatgacttgaagatcctgacatttataaagtcaccggagcttttttcttgtgccaagtcccctgactcccagttgcactcctttattcctgccatgagcttcagagcctgagtttgcttcctcttctcctccaaagccaccaccattctccctacttttctgtggttcccctgtcttccagcagtggctgcagagtcatactccctgtagcagcagctgtcaacaaatctcatagccttggtcagtttaaaggttttgttgctggtcccacatggaagcaaaattggggaaatgactcagtttcctcatcgacagcatgagcataatggtagcttgagagtgcctgtgaagaataggttagcctccaaaaaattctggcccaggacaccatggtaggtgctgaatatcagtacactgccagaggaaatggagccactcaagttttataggaaactacaaagatctgcaatcccagagtaagactgtccccaaatctcttcactgtagtcaaagccagtgtgaggagccagtgtgttgctgccattattacgtctgagaagataatctatttctccttttagtttaagtctggttcctgtgatgaggtgggaggatatcacagaaattctctctgggaaacaaagaaaactcttttgtgaggtctatggtattttttgtgccattctcccagtccgtgtcaaatcccctagtccatatcttagtgctgtgagaagcagatataaccttgaatgaatattatgccctatttaaaatgcttatttttccacacttattttctcttcaatgaatacagataagtgaataacatatccttttattttaaattactatttactgccaataagctagttaaaatatttttacttccttatatgttccttttgttcttgtacaggtattctatacttacaattttcgtgaaaagcttattatttgtatgagtaaaagagtagcttgcctttttgtgtacagcaagtatgcaactctgtctgatagctcataaaataaaattgcaaccccacacattgtaattttaaaatctttcccaacaatcttcatgctatgtcacttagacaactaattttttaaagggctgcatataaagtcaatgtaatgttattgctttcaacatacctcttggttttcatgcacaaatatctgacatgttcctttaagaagtaacaaaatctgaactagctttgagttccaagttgcaatgagaaaactccacatttaaccttgtgctcttattatgttaagactaagactcatctccaaacaaacgtatgattgagatgatgttttggaataacatcctgtgttttggtggtgcatcactcttcagtgacattctgaggttgcattgtatcagcacatgatattttccccggttaattgatatcccaggtttgtccaggggaaaatctacagctcccccaaacatgcttgacaagttattatatttactttagtcaaagcccgtgtgtgcaatatccctcttggaggtggtctattattggagtcccatatgctttttgtttgggaagaaagcagccactgtgtcatactgttacatggagtattctttttcagggatgttgttcccttggggaccatatcaggccagagttccttagtctaataagacctttgtaactcttattgtataaaagttctgggagggaggcaagagttaaacagaaaatgtaattcaagcaaccatattaggccacatgtgggaaaacatgactcttagtaatggattaaaaaaaaggtatttgttgtaaaaagcacagtgatgccaaaacgttcagggtatttcaatgtaaatgaagcctactgtggcataggactcataacattttaacatttactttagtttctgaatatgaatgatctaaaaatacaccacacagaattgtctattcataaatgtttataagtaaaaaagatgtgattactatggaagccctatatggtgatatttaatctaagatttttcttgggtcagttttcccatcaataaaatgacattaaatgaagaatcaggtgaagataatgactgtggtggcattatatacatatttttttcactgagtaatacaaaagaagtagacatactaatcagaattatccaattttatcattgtactttatcagcagatgacaaacatgctgaccatattttgtatagccagaattttataaatgaatttgcaaaaaatgaacatagatgccttttattcagattttataactatgtctttggaagaaattttttatttaaatttgacattataacttttggatatagaagtcataaaataaatacttaaaatcttttcttaattatggtaagacccattttctgaaatgagaacattttacagtaaaatttgtgatactgtggtattttgagactctcctctttttttaacagcaaatggtttcacagcaacgcattctaattcatgaagattccatgaacctgctaagtctttatacctctccttctttgcccaacattaccttggggcttcccgcagtgccatcccagctcaatgtaagtcattgcacagcatcagccttaatcaacctaagcaatatcttttcacaggggaactctctttcgtgttttatgtatttagactttagaaaaacttgacagagccagcatctccttcactgtttgctatttgctgtgttgttcaaagacattcagtctaatttcaagtcagaattatcctggttcacataatcatatgtaaacataataactaacatttgtataatggtttatagcttttaaaaaaaaagcactttccagatatattattttaatagctccacacagccatcctgtgaaacagagattacagcccacgtttttacagaaggagaagctgagacttggagagtttcaaagcacaagatcacagagccagtaagtggcagacctggaacacaagccagggcagtgctgagagctacagcttcgaaagcacagcagcatatgtttatagaatttattttgtgaatgagtttattttgggaatttaagttactgactctctggtactggcgaatatgtatctggaaaaactctctaagaaaaatattaaactattcccagaagattcaaagtgaatcaattagtttaaaagtcctgacaactgaaataggctctttcgggaagaaagcagtcactgtatcatactgttacatgaaggcctagaagtgattccttgttctggactctttgccttaaaatttcctagtactcagcagagaaaatggaatactagagatctctttgccaaagcagagctaaacttgaaatgttattgtcatactagcagaagatggcaataattattctaggcatattccctgaaacagtgtcaattttagttgtaaaaaatgtgtgggccttatccagaataattcatctctgaaatgttagttaattaaattgtatatatacaggggtcatatgatacattaggtttagagagaaatttattccaactctcatcaccagtttggccaatctttaccttcaagtcttccactgagttgaatgtgtcaagttcacttgtatgttcaacacatagtttcaatgcgtattttaaaatcaacctaagagatattatatctggtattgtcaatagactataatgtcattttatgtggtactgtgttcttataccaatgaggaaaaaacaaaatttggatgttgtcttatatctggggattataaaagaaagcattgaaaatacagaattcagctatgctcttaaaattccacatgaaacatttgtaaatgaaaaacaaaaaaaggaattaggaatgaaactaaaaataaatattcatggataatattttacagttatcactaattaaaaaatatttttccttctctatttcctgtctcttctaatgataagtaaataccaacccaaaaacttcttatgacacatgaataggcattttatttttacttatttttgtatgttctaagccactcctctcaataactcacacatggaccacttttaatgtggtcagggaaaattttttcccaaaggaccaagtactaaagccagaccagttaatgtttcagaggtaatacgatttggtaccattggatgaataaaccaatgtggtttggattaaagtttcatttttctttgcttccattttggtgtggatgaggccatcacaattaatttttcaagtttagcattgctttgccaacgggatttgtagtactccatttctacattgaatactgggaaattttaaggaaaagaggccaggacaaggaatcacttctagattaaacattgcattgacttactgtgtgactcagacaaaccacttacctctttgtccttcagtttctccattgctgaaaattgcttcgcctccctggtgcacagcaattttgaaagatgaaacatgagttttgaaaagaaacatgccacataattttgaggtattagagtcctgcttttgtaatagcaaaatgaccaccattcattaaatcctttgaataggataattcattattgctattgatgatataattattattgccttattactgtgttatcatacatttcaagttcttaatagcattttttgtagtttattatacaaaatatctagagtgtcattttcaatatttagagatttgggtatctgttatgaattaatataaaatgtttaaatcaaatttctgcatatttttacctcctttcattgggttattttaagaatttaatttaaaaaattaaacattggacacttacagctctgtgaaattattagaagccatgtagagaaagggtaaattgttccttttgcttgcaactccaaaattacagtccatcttatctccagcttcttaatccccatgatatagtctttgaataaattttacctctccagtatgcctttaacttaaacagtgtataaaatattttagaaatgtactttccacttattaagcctgaaataagcattttttgtttttttattgacatataaaaggtacatatatttgtggtttacaacataatgatttgacatatgtatacatcgtagagtgacttaagctaattaacatatgcattgtctcacatacttattttttatggtgagaacactgaaaatctattctctgagaaattttcacatgtacaatatattgttattaactgtagtcatcatcatgtacaacagatctcttgaatttattctttccacctaaaattgtgtatgtagcatcacttctgattttaattataaaacctttttatgttcaatacaatgacaatattaaattgtcttcagtgctccaaccctatttttattccttcttttttgaactgagttagtttaaaaagtccattttccctgctcagccattgggtaagatggggcttttgttttgggaagctacagcataggaaacttgtctaatgatttagagacccagtgacccacatggatgaaagaggattaacatctttgttatttctcaacacaggcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtaattcattatggcaccatttgcaggtcattttagggttttattttattagtgatccaggataatgtctcttttactcaagaccctgatggagatccacagtgctatacaaaagtttccctgatacctggtactgtgggaaaggctatcatctttatttattccttcagatccacttggggtaggaggactcacctcatttaacctttattcataccagactaggctgtggtgagtcgtatggtcagatgcgtacctgtccaatgccttgacatttctctcttcccacacctgacctattcttctgttgtttgcctggtagcatcactaattcactaattttcttacagtttataccatgtatctgttttctttggcttcttatcttttcttaaaattgtgtgtgtgtgtatgtgtgtgtgtgtgtgtgtgtgtatacacacatatacatgtattttttttttcaggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaagtaagcctccaagccaagtcaaaatgttctaaccgccagtttggaaattgggtatctcttcactgatatgggtgtctaagaggaatgttgatgggagtcacagcaaaaaggatgtgatcatcctaagcctgctttcttggctcaaggacaccatcacaatatcagtgttttaaccaccattatgttcataagacatttgtagcaaaattgagatgatacattcacaagatctttttatgatcaggtatatattttggtacacaagcccatacgggcatatgtatatggagcctcattttttagtgttgcagaaaaagtttgaggcagacttgaatgtggtgtgttgacatgtcaaaaagtttgtacaggtgatgacagataggccaagattagccagtaaggcacttctcagcaacttgtatgcatctacgttacatttattttgcgaatgccccacttcattccaataagcgtttggagtagtttctcggaaacttgtgatcatttcttcctggaagtcttaatgttgctaaaatagacagcggatgtctgtaccgtaccacatccttaggagctctcctgctgaggcaactacaaagaaacagtgattgcagcataatatcagacaggccagtaaaggattttctatgaattcgtaagcaaaatgatattaaagaacctggtctggacagtttttccactactttttgctgtggtaggcttaaaaaagcaccatcttctcattcctggaaaattcctggaaaatattaaggtcctgagtattaaaattctattcccttgcctttgtgctgtatcatctacaagttatgttacagaggcatgagaggcatgatattgcaaactgatactttgtttactgataaatggatagctaaaacctggcttagtaataactttgttgtactatgatgtaagaaacaaacaaaacaaaacaaaataaactctcatgggcagaggcttaatcatctttctaacggcagtaggggaaagggatcttcatcacttgctggttttatggcaagtgttgctggagtttttctcttcttttggcctccatcgtaacaagggcagagccatgaaggaagcatggattggataccatgcttccgaacagaaagttttccagcctagcccttcgctactctcaaagtagcaaaagtatgtgtgggattggggtgctagagatggggtggctggcagggacaactctctctctaaccttttagtatgcattgcagaccctttctgtgtcattagataatgcctattttattgctgtagcacttctctaaatttagcaaatatttcggtttcatatcaaattattttatatcaaatcagtatcttcaggagagagccaatttccttctctgactaatggcataatactcactgacttgtatgtgactctgcatatgttttctatattatggtagagttaggtttgtttatttgttttgtggcctttcagcacaacttaaaattattaggtattcttgaaaaattgtccactgtttagtgcaagaaatgtatgtgggagggaagattagggatcgtatttttttgccatatagtgttttgatctagaattaggtttgtttataaaaccagtattagatagtagatagacttttctgctatgcttggttctatttcctagaaacacatggatgtatatattttactatggtaaagtaggtaaattactcactttgaaattgtgatccacaaatggtttctatgaatacctttaagaatattttggaatacagttttttattaactaattgccactgtttcagattcagatggtgtgctaatatcagaatctttccttttcagtatcaaactcgagattttgacaggcgaatgctaacctcagtcacactggataaaactcagatgaaaagcaggcatttgcattttagcaatgagaaaagcaaatcttatcagagaccttttcccatgtggagctgattcctttgaatctgttaagaattcttcccagaattagaaacaaacctatacttttaggtacatgtttgtacagtggtttgattattaaatcttgtcttaattaggcaaaatgaagaccagaaaacttcaaagtccaaagctgatctttatatgttaacctctctcagcttgggtgtttagatgactcaagcaggtcgccagttggcttttctccaaggatgtattccatatgtttcatcaagttggcatattcacgttgggtattctccagattttgaaaatattttacctgccctcagttgtctaaggggacagagaggaagcttattaaagaaaatatcaaacccatgtcctatcctgaaatattcacaatagaacgcttaagaagtgagtggctactgttcacctgcttccgtgacgtgacaaggatgtttatttcacattgggtcagattcataacttagatgcccaaagctaacatgtttctgtataatatattgctgtatacttgatttaaccatttagaatgcccattagtaagaaatcaccacagaaattttatcatttttccccatttccatggatgaacctttatgaaacccattcatactgaagcgatggtccttactcttgagatacttatagcaggaaatacaggcacacatgaagatgttgacatacaaatgacatatttaaatatatcttcttttatttcctttttatgattcttttttgaggaatttagagaaacaaaaaatgaagtgggaacaagaaaatataagtaggattatttctaaacctgtatcagattaaatatgatgggcttcctggtataaaatttgtagtaatgtgtttgaattactaataatctttagaagaattagaaacaaagctatatagttttaggggcatgggtgatgcaaggattgacttattaaatttgaaagagtttttcatatcttgctattattttaatgtgtttataaaatattcatgttcagtgtaactacataatgtaactgttattaatcatacaaaataatttacctacttgttgccttatactttaatatcatatttgggatatttgtgggatagttgtgtgttctaagattatttgcctcttacagttacggtgtaagtgttcaagggcttagcagaaatatccctggaatgggcttgtatagtatttatactgttatatctgccagtaaataatggggaaagtcagaaaggagagtgctgggctggagaggaaaccctgtgagaatgatttatctctgctcatgagtttgaatattctatttttcactgaaactgttttgagaagtttaatcataaagaaatcaaggcttacaacatttgatcttttgttttctgagacattttacaaatcagaaatgcattaaacaggttctattgctaatatatggtattaatatttttgtgcaatgatgtcattgcacattcatttatatcatttttccccaataccatggaagaaccttttcaaaaaatcaagagtttctttataccagcatcaagggaagactgatgcttttgccagtacaccttgcttttctgattggaggaaaaaagagtttctaaagtagaacttccctcaaatacaaaatatcaaacaaaaagtaataaggtattggtaattttctcctgggcccatttcaagtttaaatattaccacaggattttttttctggtgaaataaaactgtaattgattaaaacagaatacgtaacagttgtttagacatactgatgattttaaagaagtattctaagcactgcctaaaaaataaaagggcaaatctctagtcacttcactatttgaatgatatatagaaaattttcaaaatctctttaggcatttttgttgtgaggtaatttgacatagatctctgccatgccccatccccttgacaacattattctttatttctctgttatagtattaatagaattgcactgattcatgcctagcagtttctattttaactagaatattaatatctttattaatatctgtttttcatattcattccattaaatccataagagcaggaattttaagaaaattcatactttgtttagtagttactttaatgaattattaatctatgtatggatgcgttaaacaaatcattaaatactgtgtgcagacacagttttaagcactaagaaaacaaccttcagtgtcctcatggagcttataggatggggagcaggaagtgaattattgaaataaacagtaatacaggccgggtgcaatggctcatgcctgtaatcccagcactctgggaggccgatgtgggtggataagctgaggtggggagttcgagaccagcctgaccaacatggagaaaccccgtctctactaaaaatacagaaaattagccgggcgtggtggtgcatgcctgtaatcccagttactcaggaggctgaggcaggagaatcgcttgaacccaggaggcagaggttgcagtgagctgagatcctgccatggtgctccaaacctgggccacaagggtgaaactccatctcaaaaaaaaaaaaaaaaaaccagtaatacagtgtgttaagtattaggaaaggagacataagaaagaaaactgatatctttaaggaaataaaatttgagttaattacttctctggattatcttgttcttattatatctcactccctttctttttctttcttgcttgctcgcttgttctcttgctttcttcctttcttatatgctctgtgataaatatcttgtgcattcctatgactggctatcagccaacacttttttaaaaacttacataaatcatgagatgatatcttatatatgccaaggttcggtctagatataagtatttattatatatttattactgtgatacttaggcattttgacatgagtgctattttatcataataaaaatatatctaagacaagaccagtaaatgtgaggtcaagcagatgtactgtgttgcccttattaaaacaggtagatgttatgtttatgttctgacaagcaaggcatgaatataattatgctcaaatgctggatctgagcaaatggagagctttcattagcttttggaagagaatttgactgtttatttgagtagtatctgtattattccttttttgacataattttctaacatgaatgttatatattctctgaaatcctcttgatttatacccattccctgtccccaaccctccatccacagtaacctaagagagtatattccttcatgcttgtggtcacatacaaacatagcatgcatgcctgtgtgtgtgttaatgtgttgccttgtgaagtgtccctgaaggcagttataatgtagaactattttgtgcactattgaaaaaagtataagttttgagaaggagattaattagaagaacaattctttacatgtgtctgtattccaaaagtttacatttttttaaagttatacttcatattctcaaacagatactttatattagctgtattctaatgtaattctatccatggcttacttgtaagcaaattaaatgttaagtataattacacaagggccatttacccacttttgactttttgctgcacctacttcttctagtgtacctcttcctccccttgttttaggcactgtgcatcttttcagcaccttctccatagataccttagggtagggtcatttaaaaactatcagctcacttttatatggaggatctactataagctggactccataccagaattcttacgtctatcttcccttcaaccttaacaactcactcttttttagttcaagaaaattaattttacagggctgaagtagattgagcaaggtggcagggctagtgcagagctgaaatcctaacataggttgtatgacacaaaagcctgtccttaatcatttgtgcttatgattacagtcttattttatgaccaagcaggaaaccggcttttcctaattttatttttgtctaaaagtagaaaattcacagttaaaaacaaggcaaacaaacattaaaaaaaatagggtgatcttatttttcttttgcaccggtttagatttgccacgatgaagaaatcccctttcccagctctgcctcccaacttcacacacattgacctccttcaagttactcacttggcagtctttgcacgtggacctgacggtgagacattcagatatcctgttggattataaggctttccaaacggtgcagagtgaatgcagtacagagccaactacagccaggccacatttcattcctttctcgcatgttgtcacattgccgttgttttagattggacaaacatcttctcacggaagttctgggcaagcctgaagctggaagttaccgacttcatcaggttcaactgaaatgcaaatgttggcatctcatctatgggtggttggaaaatgccttgttttatgttttgaaaaatggatgagtagaaactggaactgggctttcatttaggaaagtaggcattagtgttgtcaggtttaatttctctccatccatttgacagcttgtttccatgcagggtcttttaatcaccaatttaggattacattttgcccattacatggatagtatgtccaaaaactttagcaagcattgaaaggcagtcttaattttataacagtaaaaagcctcctagattatttatctatctatagaggtttataaaagaaactttgacgttacccttaaatcgatgttattctgagataattggcccaatataaatagattcttttaaatacgtagtactaggtctccaaaaaaatccacttatagaataccagcttatatcatcacaaggaattcatatagatgtatttcactatataattacaagttgatggtttctaacatacagaaagtggcttgttgctttattattagatgtgatgaaatcctgtgtttggaaaagaaacaaaatgaccatttcagtggattaatgtgcagcattcataaacattcccagtgctgctttcataacttggagaccaagggaagggacctagacctttccttttcactctgcactgttaatctagtcagagacgcttttattgaatgagaaaaacaatagttggacatgactatgaggtaagaaaacggggggaagaaaaatatctggggaattaaaccacgtgaattgtttgattgatgttgattccaggcagttcaaagggaaagggaagctaaataatttggttgtttcccaaccttgacaagtagtttcatgtgacagaatgaaaaaattaggtcttgctaaggaatttttaatatagttaagtgatttgtagacatgaaaactgccagtgggtagcagtctcttttttttttttttgcatattttggtagcttgcaagttcctggttttagttcttttttcctgtatctttcagctcttcctctaactacttatgaaatctgaggaactacagtgaccctgaaatgtcatctggtctagagtattcctcttcctgcaggcagaattgcatccagagctattctctcatatcttaaatgtactgctgctctcttgctattaacctagttgtatcagctagcaatataaagtcctgcaacagtctccggtcatggaataattgatgatgttccacaaagacttatctattaacaaccattacacttcattctggaaatgaaaataaagaaggcatgttctttcccttgagtggctcaaagacctgtaaacagatcattataatcaaatatgattctatcaaatgcatagctcacatgaattgcaaaatctatcatcttgatagatttttcaagagaagtttctgaggtcttgcacaattatttgttttgcaatattggtcaagatattcaacctttttgtttaataattccataaacagcaaatttttgaggtttacagtgaggattacatgagagaacatatctgaaaatgctttgtaaacatgataagcaccactaaaatcttatacagtatttatattcttccaaatcttagctattgtggacagtgctgtgacaaacataggagtgcagatatctctttgatatactgatttcctttcttttaggtatatgcctagcagtaggattgctggatcatatggtagctctatttttagtttcttgaggaacctccagactgttctccatagtggctgtactaatttacattcccaccaacagcgtacgacggttcccctttctccacgtgctcacctgcattcattacgggtccatcttttggataaaagcattttaactggggtgagatgatgtctcattgtaattttgattttcatttctctgatggttaatgatgttcaacattttttcatatggtgttggccatttgtatgtcttttgagaagtgtccattcatcttttgtccgttttaaaatcagattattagatttttttcctgttgtttgagttccatatatatcctggttattaatctcttgtcagaggggtaatttgcaaatattttctcccatcctgtgggttttagcttcattttgctgattgtttcctttgttggtcactgtgtttaattgggtttgccctgctttccagtttaccaaagtaaggaattgatcaatgggggaaatggcgatgtttatgagttgggagagagtgattcattggtttgagattttgtctattctgagacccattcccaaatcatcaatgattagcaaagaaaataaggatgcctttccacactgtgcctctattttctactcttaaagagaaaaggaggaaaacttgggcagaaagtatactgtcacctgaaggatcctaaagattatcagggaaagaatcctattaggtaatttttaaaaggacataaaattatgcagtgctataaaagaagggaaaactgcttatttttgtcctagttaagaacactgccccaacccctgccaagaaatcttggttaagaattccacactcttgctgaggattgtatgttttgaaaattcagtcttcctctttctacttttgctccctaaatccagtcttccatagcagccagaatgatcatttcaaatgcaaaccaaatcatgttatggttaaaacaccctacttgctccctcttgtttgtaggataaaatccaaacacttttacatggcctacaaggctgtcatgatctgattcttgcctcctcccttgccttcatcatctcctcccttccctctctctctaggctccagccacactggccccctctcttatctttgaggaatctccttccacctccaggagctgcgccagccactattttgtgtggaaggctcaacctccacgtcttctcacggtttgattgtgttttggggtctgtctcagctcaaaccttacctgttgagaggggtctttattgcccatccaaacaagagtaaacacaaacacccacctgctcaccccttctttcagctccctatcacttcgagtttcatttttcagttgctaattttctgcctcccctactgtgtgctgggatcttgcttgattgacctttcttttcctaaggcctggcatatagtaaacgctcaataaaaaattattggaagaatgaaaaaatgggtgggcaatgttctcaaactagttggaacaaaccttcagtttccttcccagaagggaacacttattgaagttactgaaatattagcaagttttgagaaccagaggaaaaaaaatttaattgcaggcattgttttggacaatcatttagagttaaaaagatgaagcagcatttattaaaaattcacttcatgctgagattaattttgaacctctttaatattgcttagaaatggtatttttcagtttagacttcaatttgtgtgaataatgaaccaatatttagaaaatctttcttctcttgttatttaattttggttcatctgattacttccctaaaatacacagaagcaaaatgacatggagtattattttggcttgaggttggagttctactccaagtagacctctcaatttgaaagccctccaagctctgcatgttgttttttgagaacagttggtccatacctaatctatttgtgaattcaaacagaattttatcattatttttaaatctagtttccttggagcttaagggaaatgttttattttccaaaggaagaatattacatttatttaaaagaaaaaaaaagcaaaaaaaaaaaaaacaaaacaacaacaacaacttctgctattgccattccccaagtacaatctgtcttaaaatctgaggcaaaataagaaagtgatgagttgcattgaagttcactttgcatagtttaataatcatattcaaacacttgtatttaatggtatgttgacaatgtcagaaaatcagatgtttatgaggaacagatttattcttacatgatcctgttcttagttgatattttgtatctgaagatatttgttgggatgcaaaggatttctgtgggaaacattaaaattatagaatttaagcatattttatttaaaagtacatatgcttatagagacttatagacttgtatcaagttatataatttacacagaggtgaacttaaagtgctaacatataaacattagtgacagtctttaattattatttagtgaatttttcatcatgtgccaatagaatatatgatgttaaacatggaatgtgagattctgaaattaaggagtttgctataattatgacctgagcagggattgataagaattgaagtttagttgtaatccttgaagacttttgaaatttggataaattacgatggtatctggcacacagaacaacatctgtttgagtatatgtaagtgtgtgtgtgttacaaactcagaatggtcataggctgcccgtggcatgcttagtgttcggcccaattgctatacagtagcacagagaatagagagacagcctgacagatgagtatgagcacacacaaaaggcaaaggagaagctgtgcagctgccctcttcttcatctctgctgggttccccactgaagtaactcacctggtgtcagacgagtggcacacggtgtgttttacagatgaggcctcagcagagattcacacaggcttgcacatttatctgtcccacagatgtttcgtcttctgttatctagccaacaaggcaacagctcgactttgctaggggatcacctccagatgttcaaccaaagagagaccctgccaccccactgagagtaagcagacatctcctcactacatctggggccactcagtgacagtacaaattagaaaagggttagcccataccagctttgcagtggtcatatttgtagttgagaaacacatagaaaacaaattccaaatactcattttcctagtaaatagtcggaaatttacaaatagcacaaagtaacttttataggaaataattcaaatctggcaggcaagaatttctctgtgacttttgtttgtaagttttccttgctgaagttaattgaaaatttttccactgtgacaaatttgactgtttaaacaaaaacagccttagtcagatacctaaaataagaagtgtagattaactccctttctgcatttatattttgcaacactggcaccggatgtcccatttgtcttttttgtattttgtgaatctttacaaagagcatattttattccagagaagatgaaaaacgggtagttattgctcttttagacattgactttgttttgtaacgtaggagaaaaagtgtcaaagcattgttactaagcattaataattttttcagaaacttatgaagctccaattaggtgttatgcaatgtatcaggtactaggatataaaatgatgaaaaacatatagcttatgccctatgagatttatattatagtctgggagataactatattgtaaacaaagatagcgatatgatgccagacaacaataaggactctaaagaaaatatattaatgagataataacagaggtaaaatatgataagaaggagccagtcaggcatgtaaagatttgagggagtagagagagcacggcgtagactcaggccttgtgggcgaacaaactctgcatgtttttattcacggggcaaccagaggccagggtagctggagcatgtgagaaagagagaacaagatcccaactaaggtcggagaagttggtggtgccaggttgtcgaaagtctatggaccatggtaggaggtttgaattttattataagcataataggaagtcagtgggggattctaagcagagaattaatgttacctaaattatattttaaaaatcattattagagctactgtaagagattgtactgttgagggccaagagggcaatcaaggagcccagagtagggcctttgggtagtttagggtgaaaatgatagtatttaggagcacagtagtagcagcagaaatggagaaacatgttaagataaagcctttatttttggaggttgaattgccagggcttgctcacaaattaaatgaaaaagatgagtgatagagaaacaaggataaatcccaaatatttggctcatgcagttgggtaaagctgtttactcaaatgagaaagattgggtgatcaatacaattgggttagatgggaataaaggttatttttgaggtgtttaatgtttatgatgcctattagatattctagatctaagaaaacaagttaagtacgcagctaactatgcaagtttggagctcaggggagagattggaattgctcctattaatccagttgtcatgagaatatatagctatttcagagcaaaatgtggagtagaatggtataaaaagttctaggtttctactctttttttttaaatcaaattcatatcttacaatcttagagatgacttgtcttttttgggcatgagattccttatttaaaaaataaggtttttaagaatgttattaaaagattttcaagtccagcattttatatctatatgttttctactcagaagttactgttttatatcaagaaacatttcttttacaaaccatgaaggaattctgctcttggaaaaagatcacaacgttatttattctggcttttttcttccccatgtttcctttgatagatcagaagtgtagatgaagccaaagaaactgaccggaacaaatagaattatttctgtattgcatatcaaaaattgttatatatactgtcatatgcatatctgtgtcagtgaggttgtaaatactgaccagatttgattaatggactgaacaatgtgatttctgggtacttcagtgacttcacaggtcagatttcagaaggtcttctgttaaaatgtacatataatacgttccatggaaactcaggggtttgttaatattagagattttccttaacttgctaacgatgggaaattatattctagtaaattaacactcagtttgtctggtctttggctgcagtggtaataccagtctcttattttcaaaaatgctatgatttttgtgttatttccctttctaaaatgtttcacctttgctgccacctattaatatcatatttaaatggccactggatttggcattattgcagtcattattgaccttaacaagagattttggttaaatggtgtagaggaaagcctaaagagaaggggaaaagagaaatgaagacagtgaagagcgataactcaagaaattttattgtgaagggaggtatgtaatggtgtggtgggggaggaggtcaaggaaagttttagttaagatggatgatattgctgaaagagtactagtgagagcattccagcagagaggggatctgtgtgatggaggacacagtggataattgcaggagtggaagggatccagagtgtaagccaaggggttgactgagataggagtgcagacatttcactcattgcaacagcaggaggggtggatgggatagcttcataaatgtgctggtagcaggaggctgagtttctcttctgatgcttccattttctcaatgaaatgagaagcaaaggtatcagcagggagtgaggaaaaggggagaatgttagagatttgaagggagaggaggtagtacgagacggtgaaagtaaattaactagaaaagtggaatagggttgctaggcagcactgagaccccattggagggtgtagtcatgaatttggagaacactcagcatgatcgtaatttgtttgtttgtttcctagctcattcagctgcttgggtttggcagagatttagtattgaccaaggttagaagtcttatttgtccagtaaaacccatattgaaaggagcaggagcactgatggtaatataaaggagtggttttcaatgaagtatggagcctagtccagaaaggagggaagtgagcaaatgaaggggacaatatgtagtgagaatgtggcttggaaaacccactagaatgaggaatggttggagtcagactattctgagaaagagccagaagaaaggaatgatgtttgaaattgagatttagagtaatgcagggttactgataaagataggtctcaggtaaggtcataatgttggggaatgaggtcaagtggaggacaaaaccattggaggttaggaggttgagacactgagaggccatgttgtggccagggattaggaaggagaagaatcgcaacagaagagtctttttacttggtgggtgatatttgtggcttcctcttagttattgaatatttcctgtagtgtcagacatccagaagctagctaggttccaagtcgcgccctccctccccctcaccccccagtaagcagggacttccgacatagcatttcctggacactggctctctggctaatctttcatccggtactcagttcctattccatgaccacacatcccgtatagttcttctgctatcctcaagaggcccttattggcaggatcctttgaacacctctccgggtatctacttgaatccttagtgtcattggtccactagctctactgagcaggttcccagtaacttttcagctgtgctgtgttagtgagagggagagtttctacagctcagtgagcatttgtccagtcttcttacatttggtttctctgatgggctcctgcagcctccttcacctggcttgtatcttttctcagataaatcccttcttcccacaagctcccctcacctgctcttatttgtagtctgaggtatgagtaagggttgcagcactgactgatagtctctgtccctctctctctctgaataatgagcggatgtttgttacccagtgtccttattcctggcatcccagccaaaactaggaatttttctttaatatcttgctcgtttctatgctgttgcatattctttcttaaacagccaattaaatgggttcctacaactttgtagtcaaaatttaggactataatatggtctcttttctccagaatctcagtagtgtccaaagtactatgtattaaagaaaagaagagctgattagtattcagaattgggacaaaagtcctgcaaatagtttcctaaaatatacttaaagtcatctaaaccatgagtaaatgaatgtcctccttctcccgactgcccagtaacaatggatgttagatggtaggcacaaaggaaattcatattcaaatttcttcattgtgatatgagttttgattggtatatgttttcttagcttgatcttgtctgacttactttggtgatatttaggtcttatatgtgtttttcctaagttatattttatttctctagattcttactcttcacccaaatatattataaattgtatcatctactttaacattatctttcggcatgttcctctggttctcaaactccactagccttttggtgacttagatgcgctggtctccttttccaatccaaagtccccacagactctgccttctaccagaaatgctccccacccttatttccgcccctgcttcccacccctcacacatgtaacttactcctttccatccttcattctttgtgtctaaacctaaatataacacttcctcagcttaactcccttaacaatccccatttccactgctatgccaagcagtatgtgctcttataacaccttgtgtttctttcttcaaagcattttgtcatacttgaaaataggaataagtatttgaagctttctaagacattcactaaaagctccatgagggcagagcagtggctatttttctaatgcttagcatggtgtcttgaacatagttggcactcagtaaatatttgttgaacaaatgaatgaaaattcctaataaatctacctacagtgaaatcaaaggactttgttagtgtgttcagggccatttgaggttgcgtggactgcaggaaagtctataagcctaaagaggctgaggtgtccatctaagtctgagtacttaagtattcacattttaaaacatgtattttgtaattatgtgtgagtgggaggtaagcatgaatttgacaaagaaaaatctgcattcatgtttatggtggtagtattataagtgtgctgctagttacaataattggcatgttgcttacataggcactgacttagcagaaaacttagcaactcttgaaaacacagttcaaggtctgcagatgatttggtccacagggccactgtgaaataaaacaaatgaccagtgtgagacaaaataatcttgagactttttccccatttattgagctttcatgttatgatattttgctattgtttaagttaggcatattgtcagttatcttttaaaatcattaagcagttaattcattgacttctgaaaactaagttcaatctaatttataaaataaataaaatgtctaaataatgatttccaaattaaaaaataatttcctgattcttttctaatatttaatttccatttgagtctgttcataaaacatcttattgttaattttttttaaatcatacacctctttaaagttcagaatatcaaaataaatatttctagttcttacaaatatatataagaagatgctttttcatttgactgtcgtttctctgtataggtacaagaaaattagacaaagactattagcatttgtgttctggctttcatagcgtttaacattcgttgaaaaatgatattgacaacattttttatcaccccctttatcttttgagaaaagtattattcccaggttcaactttcaaaacatgtccttttgaaagtttcagggtttccatggatagtttatttacctttttctacaccatgttctaactgcattaaagagtgatccattaaaaagaaaaaacaatccaacacttaaagaccttattcactgcctactggacccatacaatatggaataatgggactactttagatttagtattactgaggaaacttgttgcctacaagttcattctgaaatttatgttcaatgattagaaatcacagtgtatgagttattagaaatcaaagtgtaatttgcttctctgttaccatgaagaactactgaattttgaacccctgaacactctcttctagctgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaaga

SEQ ID NO: 2624 - DNA, 294437 bp, Homo sapiens
actgtgtaactatttattgctgtgtaacaaatttctccataaacatttattatctcacagttttggtggatcaggcattcagaagcagctcacgtgggtggctggtggctcagggtctctcatgaggtttcagttaagatgttgaccaagactgaggttacacgaaggcttgactggggctggagaattggcttttgacaggaggcttcatttcctcatcccatacacttctctgtagggctgcaagtcttcatgacatggcagtctcttcccccagaataagtgatgcaaagagaaggccacgctgccttctatgacccagtcccagaagtcacacactgtcacatctgctatattctattcattaaaagcagatcattgggtccaacctatacaaaaagggtggggaaattaagctccactcttgaaaagaggaaaatcataggcgacccatattagaacaagacagaattctgcacagactttcatcaacaataactaaccaacagagggcatttggcagaggaagcaaaccttctgtggaataacgaaacctacggtacagagagtgaactctcagccacctcccaggaggacatgaaacatcctctgcagagaacaattagagtgcagcacatttcacaacattgctgaacactgctccaacaggggcatgctcctggtggaagcaaaactggggctcagcttccatcctaggcctctggacccgtgatgggaagggttctttttccatattatttaaaaaataactaaagtcaaagggacattgtatatacagaacagtgtttgaaatgaacatgtataaccaataaagaaaacactaccacaaagagaattagaacattgccaggctcttaaaagatctgattctcccttcttaaccccatccctcttcttcccgttgagaggtaatcactatcttggctttggaataatcattcccttgcttttcctcgtttttttgtttgtttgttttgcttttttcactaccattgcatgacccctaaataatatattatctttctctgctttcaaaatgtaaataaatggaaccatatcatatatgttgtcctgctacatgcccctttggtgcgacagtgagtttgttagtttcattaattgctgtataaactccattatgtggatatacctgcattggctaatccaatctaatgttgatggattcttggttgatgaatgctcatgaaaaaatttcttttttctatatgcatgacccaatcacctcccaccaggccccaactccaacactggggattacaactgaacatgagatttgagcagggacatagatccaaactgtatcagacttttttttattaactttaattttgagttcaggggtacaagtgcaggtttattacatagataaacttgtgtcatgggtgtttgttgtccagactatttcatcactcaggtattaagcctagtacccataagttatttttccagatcttctccctcctcccaccctccccgctctgaaaggccccagtgtgtgttgttcccctctatgcgtccatgtattctcatcatttagctcccacttataagtgagaacatacggtatttggttttctgttcctgtgtgagtctgtgaaggataatgacctccagctccatccatgtccctgcaaaggacatgatctcattctttttatggttacatagaatttcttggtgtacatgtaccatattttctttatccagtctatcattgatgggcatttaggctgatttcatgcctttgctattgtgaatagtgctgcagagaacactgaggtgaacatgtctttataatagaatgttttatactcctttgtgtatatacccagtaatgggattgctaaatcgaatggtatttctgtctttaggtctttgaggaatcaccaccctgtcttccacaatggctgaactaattcacactcccaccaacagtgtataagcattcctttttattcacaaccttgccagcatctgttattttttgactttttaataatagccattctgactggtgttagatggtatcttattgtggttttgatttgcatttctctaatgatcagtcatgttgagctgttttttcaaataattgttggccacatgtatgttttcttctgaaaagtgtctgttcatgacctttgctcactttttacaagggttgtttcttttctttgtaaagaaattaataaatttaagttccttatagatgctggatattagacctttgttagatgtatagtttgcaaaatttttctcccattctgtagattgtctgtttactctgttgatagtttattttgctgtgcagaagcttgttaattagatcctatttgtcaatttttgcttttgttcagttgcttttggcatcttcatcatgaaacctttgcctgtgcctatgtcctgaatgatattgcctaggttgtcttccatgatttttatagttttgggttttacatttaagtctttaatccatcttgctttaatttttgtatatggtgtaaagagggggtctagtttcaatattctgcatatgacttaccacttatcctagcaccatttattgaacagggaatcctttccccattgcttgtttttgtcacttttgtccaagatcagatggttgtaagtgtgcagtcttatttctgggttctctattctgttccattggtctatgtgtctgttttttgtaccagtaccatgctgttttggttactgtagccctgtattatagtttaaagttgggtagtgtgatgccttcagctttgttctttttgcttaggactgtcttggctattcgggctttttcatatcagactttttaatgtttgacaatatggtgggtgcaaaatagatattattttgattttaatttatatacccttagttaccatgagcttgagcattgtttataattaattgttcatcatgtttccactcttgaaaagtgatctattcaattcttttgcatatttcccaccgtttttacttgttgatttacaatagttaaacattttggttactagtgttttgcaggtgatatgagttacaaaactttctcccagcaggtagtttatcttttcactctctttaatgatatattttaatttaaacacccttaatgttaatatagtaatatctatcaatatttcttttacaggttgtagtttttatgtcttgttttataaaaccgttttgcacctcaaggtcatattctcctgtaataccttctaaaatgctttataagtttaaattttacatttaaatccttaatcatatatgtgtgactgatttttacatgtggtattatgtaggggtccaattaattttccccattataaagatttctagttgtttggcctcatttattgaaaaatccactctttctgagttgatgtttagtactatttctgattatatcaagtatgcatatctgttagattagtttatggactttcctattccattgttgtgtctcttttgagccatccatactgttattcttaattacaataactttataataagatttagttcctaggggaacaaaaaacacaacacatgtgctgtgctttcaagcatagctgggcctgtgcaatctggccctctgtgtaattttaaaaacagcttgtaaaaaaaaaaatgtactgccggattttttttttcagaggaattgcagtgggtttctagattatcttgcaaacaatagacatctttataatatggaattattaaatccatgtacatgatccatcacttcatttgcttacgttgtctttaatgtttttaaatgaaggtttattgttttcccataaagctcttgcatatctttatagaattattcttaggtattacatttttatgctattgaaaatgatatatttttaaatttaaccttctcaatgtatatgttagtatgtaaaaatgcaattgaattttgattccaacaattttgctaaaactcttaaataaaattcaaaaattaacctaatgattaattagaattttatacatgcacagccatattttctatgaataataatagatttgtttcattccaatacttaccatttttatttcttttttccttaccatagtattctggtgagcctccaaacctatgttgaatagtaagcatctttttcttgttcttgacagcaaagaaaatgcttttaattatatagctttatgtgaaatatttgctatacattttctatagacactattatcaagttaaagaagtcatattcttttcttagtttgctagtagttaataagatatagatgcttaattttactttctatatgtattcagataatcatacttttttcctataatgttttcatgtgggggatacattaattgatttcccgatattaacccaactttgcactattttgatcaacccaccttgatcatgatataatttctttcttatacatggctgaattctccttatgaatatttggttaaaatttttgcatcttgcattcataagaataattggcctttttttgtactgttattgtttttggcatcaaagttatgttagcctacaaattttaaaaattttattggggagtattattcttttttatattctccaccatattttgggaaattttggaccttaaatatttgattgacctaactgatgaagccatctgactttagctttctttgtgggaaaagctatgactatgaattcagtttctttaatggctgtaagatcattcaggttttctgtttcttcttgtgtcagttttgctaggtttgttttctacacaaatttattcatttaatatacttttcaaacaaataggcataaagtagttcacaacatcttctaatcatttgaaagtctttagcaaccatagacttatccccatttttattcttaatattatctgtcttttcttttttaaagtactctcactaaagacaagatttgtccattttattaatcttttaaaaaactccaatttttatctttgttgattctctgtattttcagttgttcaatttgttaatttctgttatctttataatatcccacttcctaattgtttttatttgttttttgtttgttttgctgcctttttgccaactttttaaaatggatgcttagtttactaattatcatccttttttttctatttcaatataaatatttaggactataaatttctatttgctgttttagctgtataccacaaattttatatgtattttattatattaaatcatattgtctaaattacattgtaatttcttttttgaaacgttagtatatttcctaagtaaatttttctacttaacttttaattgacatctagcataattactttaggtctgagtaggtattatattattttagtcatttaaatgtgttgtgattttctttataaacctattcatggtaaatttgtaaaaatgattcatgtgtaagaatttgtattttttagttgttgggagcagtactctaaccccattaagtcaagtttgttaatcttccatttcttgttttttttttcacctgttttatcaatagctcacacaactatattaaaaagtaggtatgaatgtagtgcaagaaattattttcttcttgttataaaatcaaaatgaaattgactccaccaagaattggtgagaattttgaatattttaatgtcatcatcattgtgagttctgctctatccatagatcctggaagcaaaagtcttctggtcctcagtgcacactctttgctccaaaccctataggttgtggtttcagtgtcaagtaaaggtacagggatccctgatggggctagaatctgcataaccaaggcttcagctccctggcagagccacactctgaattcctgtaagtatccaggacttaaacattcataatggtctaggtccccattgcttgtgaatcctatagactctaatcttttcccattaatgggataacttctcccaacatctctctcgttttgctactcttcttattgtttccttttacattttgttttcaaaaatttccccaagaactttgagaagttcaatttaaactactctaccttgggcttgagggtggaggaatgagatgctgagacgtaagatctggtaataatgcctacaataggcatatttccctccacagaaaggtcagtacctctgtaaatatacaaaccaactgcctggcttcctgtttttttctgtatcacgttcttgtagtaccattgagaaagtagcactgggaggttgaaaatgtacctggctagcatccaagtcctgggtctgagttcaagctctgcttttcactagctacatgttttaagatgtatattaccatcttggagtctctacttctcatcttcaaatggggacaggaattctgcaagactctgaggtctacaaagtcagggcctgtgttctatttctttttgtattccttgggcctaattccacatctactattgtagatcaaatctttgttgtgaatgaaagaataaataaatttctgtcttcaagattttttgctatgatgaactgagacagcacatgagtaagctctttgtaaactatttttttttaagcacatgaaaaatgtatattgttattgtcacctttctattatatttcacagcaatgtgagatatcctcaaatatgcttttacatccctcatcctcaaatgtttagatcatcccccaatatttacatatttttcagcaattgtttaatataatctctacccaaggaagagatagaagccacttgaaaaaaagtcttagggacatctcccaaaactgcttattatttgaatggcttatattttaaaatgtgtgcagccaatttttcgctctcttgtgctccaacccttcttcataccacaggctgtgggcgtctgccccacagaccctgacccaatgacagatgaataatgtacactgacacacagatattctgctttgccagtccagctaagtgtctcagctgcttacagactccctggagagtactgtaaacagttgtcgaccagctagtgagacttacatttatttggtaaagattaattgacaaaggctcgagtcaacaccactacagggtaattgacaatgtggacttcccgagtagaaagcaattaagcacctgtggtaaatcaaaggttagtcttaagaccacatgagtaaacaagctagctagaaaaactctccacattcctttgttactactttaatatatttaactaaaggtaaagggaccaggccaccttcagccagatctattaccgaagttatgcaaactctcaggccttccaagagagtctgtggctgttactataaccatctttaatatttttcccaccagcctgattgaacccctacaacagactatggtaggtcagacccagaagtgccaagacttttcagacatggtccacaggtgtagcaagatgccccaagccccactcctcagtattttttggttcattaaatacaaaaaatgaacgttgtacttggccttatattgttttttaaaccacagactgcttgggttttgttttgttttgtttccatcactagtatgttttgctcctgaagattgttttctgaccccatgcctttgctcaagaaaagaaaaaattccctgcctggaatgcattctattcatcaaaacccttccctttctgaaatatcacctccttcaataagcctttcctgctcagcccactatatgagtatgagtatcctcatactcagaagcagctcacacatgctaagctgccctactccaattaagaagaaaatactaacacagcatctatagctttcattcaaggaaggctgagtacttgttaagatcattttttctaagttcacttagctgttaaagcagcaagggcaggatttggatcaggttctgtttggttccaaacccaccatgaggagccactgtgctgttttacctctgagaaagacctgacttaaaacccgacctctatgttatgagagtcaggctcctaggatggggaaccacgataggtgcatgcatgtcttgtcttgcattagagatttttatgtacattttccctttctagattataatctctccaagggcaagaactccctaacacctttctgtacctcttacatcattgtgacatcaaagattcttagcaaatgcttgttaagtaaatgagagcagacattcttgctccccactgattttatcttggatgctaataatacagtaaccttatttccaaaaaccattcccacagagcccgacacaccgtggaacaaaaactgagaattggattgaagaactggattgagaaaaggaaacactttggtgaaatcacaacctgtaaacagacctcaaaacatagtgttcactcaactgaagctgaacgttctatagcctgggttcatttggcttgattgcgcatcacttgtttacttggtgtgtataacactccacaggagtcacagggtccttttataggcatctctggtctgttgtgggccccgggtagtcatagtcccactgtcttgctcattatcctcctgcacccccaacacaactggacatcacacactaacttaacaattcagcctccttccaactgtcttaccccttctatctagtttcttcctgccttaattaacttcctagcatcatatgaataatcatttgtttgtttgctcatcctattgtggttgcccatcctatgatcttaacaagtactcagccttccttgaatgaaagctatagaccctctgttagtattttctttttaattggggtagggtggcttagtgaacatggacctgacagtgttggtttaaaatccagtgaccattgcatagttccactttaaaatgccctatgtcacattagtgtgaatgcacagaggcacagacaggcccagggtctcaggttagaaaatatgatgaggggaggggtttcttctaaagagaactgtggaattgtcggatgtgaatctgggcctgttgttcgtttctcgctatgcatgtttccatgggacggacactcagttgttactctcgctctctcccaccacttccgctctctttcacaggaagaggcgggtcctaccctgatggaaaccggttctggtctctgtccaatgggagtcgcttcctgtcctgcaccttcccaaccacatcagtgaaagggtggaagtgctggtctgcccactgcaggcttaacccatgttcttcctactaggaaagggacgtttccattttcatccacctgactcccgagttggttgcaaagatggaagaaaggaacagccatttattctcctggaggcaggccctgccggacttgagagggcctttcctctgaccctaagcatcagagcggatggagacagaaaatcctgaggccgctgtatggtgggtctcttcacagccatggggcccagccccactcgcctccaccaggttatggcccagcagctgggactccgtccagaagagcacctgcagcacgtatcctgtgttctccatcaaagcggcctggagtccgcctgcgtccccagcaagcagcactcccgccctaaaaccaaagggcgcagcaaggaaatgggagggctgcgctttgcttcctgtctgataactaccaacaaccgggcttctgcccagcatagctagataaggggagggcactccatttgacatgccctgaagactgtccaagcgatggcttaggaaggccattccaatttcaagtcctgaaagctgtaagatttttctgtgacttagagtgatttataacatagtttaacctctcaaagcttcacatctgtaaaatatggataaaactatctcaaagcggtattgtgcaagttaaatgaaaaagatagtgtatgcacattgtttggcactaagctattattattatcaaaagtagtagcaattagtattattgtttaaaggagaaaatgatatccattgggaggctcctctttggacctgaaagcttaatatctggaattacttagaactggaatgccagcctccgcctcctgccagcagcctgctgccaattctgatgagacagcttagaaaccattgccctgatgccatagaaaagaagaggacagctagccttttcctttctcttcacccttaatttaaaaaggttgggcaagttacacatccacccacctccaaacctttcaaacaagtttcagttatattcttgccgagtagaaaaaccaaaaattaataagagaacttacttaaaataaaaagttgttaacatcttgatacatcctggctttccagttaagagactttacagaatggttcgtgacttctacaccaaattctttcttgtatattttgtctacaccccaccccttccttagcctcaacctcatgagtgcaaatggagatcagccctggctcctggcatcccacgacgacttggaggtggaaattgttagtctggagtgggattgagggcccctgaggcagactgacactctttcagctgatgcatgtctaatgctgagcaggctgtgaccaaccaccctcaggacatgtttttatgcaagtgtgctgtagggggtggtcttcctcataagtgagaaaacatgaaagcaaagttcatttatcccatcagttggctgcttctcaccattcacctgggccctgcagtgctgagaaaataggatgtattttaatctccaagcagactggactccaatcaatttagagacacagagccacaacataattcaatttggggtgattccactgtctctgtaatgtctaaagccctaatgtactgctgactcttaggacaaactggcactgatcaagagtgaggccactaagccatcactgatttcagactctcacccctgactttctatgtatggacaacacttaatatttcacagaacccaagttgcactggaccgaagaagacctaaatagccatgtagtccatgtgctgccaaacacctggcaaatagttgcatggttgttaaataagcacacctcatatccaggaactcctggacaaaggctgaccattccatctggacctcctccaacttctaaaaagctttctcttgaatttggccaatgggcatccctgctgagcccacctttagtccagatgttacctttctggatgttcattcatgcatatagctgcaaacgttttccaacagcttgatattgctaggcactgtgctgggtcctgaatcaatgggtgataagggtaatcccactttcagcagagacactgacagcccctacttgacatggtcctgggttctctcattccccttgtctctccccactgaacctgcactaactgtcctatgtccctctttaagtgtaggcccagaattgatgttgcagtctaatgtataacaaataagtcctcgtttgtgacctgtttcagaaaatgcaacctaagattgggcagtcatgtcaccttcccgtttaattttctgtccatatgaggcaaaatagcttaagattaagaaaaagcttttggaattaactagccctggaacaagcatttgttgcacctcttacgctgcagagctgggcaaattgttcaatctgtcaagacatttttttaagtgtaccgtaggggcagttggaaggagtaatgaggcagtgtgtatacagcacctgacctagtcatggctcattaaaagctgctattctacatctcattgctgtcatctccaaaacgctgaagtcttttcacatgtgctgctgctccatcaaactcccagatgttttggggaggactggatggaggtcctaacaccttcaagatctaacccgtcacctcagcctgttctttggcatcctggatgtgtcacataacctattgtcatctcagccccatggcatttggagctgagatcaggatagcttctgtatcctcatctgagtaaagtatgaccaagtaagttcaagggccgcagcctggggtttaatcctgcgacctcccttctagacgagcatccattttttaattagtactgtttggctgtgcttattcaatgagtcatgagtcataaacttgtaacatctccagattgttttatgaagtcatatcaggatgaaattctgcctacctactatttctgtattatcttctttaggaaacatgccatgtggctacagaacatgaaaaaaccattttttttttccataaagtttctacatataacatgcttcctgcagaagtttgtaattcacatattctagcactaattataatcaggtaatattatgactttctccaacagaataatagtttaacatttttttgtgagaagataatgatgttttactcagtaaaatgagtttaaaattacaagttagaaaagtttatctagttgtttctatatagcattaatctgggctgctttgtcaaaaatttattttatttttgaatcagggtgtcactctgtcacccaggctagtggcgtgatcacagctcactgcagccttgaactcctgggactgcagttgtgcaccaccatgcccggctttttgtatttatttatttttttgtagagactgggtactctcatgttgcccaggctggtcccgggctcaagcgatccacccgcctctgtccttcaaagtgttgggattacaggtgtgagtcaacaagatttctttaaaccaaggttaaaagataaaaagaaggcacagaatttggtgtatttttgagtagtccaaagtaatttttattctctaattagtcacctcacgactttatttgaatgaattaatgagaagctaaataaactagctttttaaaaaatattttcttctctttctccaggcaatgggtcactttggggcgctgcagaacatctgtgctttccctgtgccccatcaccttcccagctcctgagctgtagccatctctgctgcacctgctgtcagagggcagctcctccggctcctgctcctgggttgcaggtgccacatctgtgcagaaggcttaggagaagcagtgagccttctaactgcagcagtcctgacaaagcactttgtgaacccctccgggacataagggcatcaaactaggaacaaaaacacagtcttgactgtgatttggtgattttaccacatacaaggcccgaaagccaattgaagacaagaaaagaagacaaatctcttgccagcaggagtaagattgtacaggagtctgagtatacatcagggcaagccaagagacagggacaaacagagagaaaaggttcatgcaattatgaatatgacctggagggggctttggaattagattacaacagtaacagagagttaatgccattttgaaacaatttaagaattatgtatttgaaggaactcagtattatcatgttatccaaaattatcccagttgctcataagacttgctaataacctggactgggggtggagggttgagggatctaatggaaaacatctgttaaaattgaatatgataatcatgtcttgtttttatgatcttgctcatgagacagtcttgaagagagaactgagtgattatccaagtaaatgtgtatttctatgaagaatgtaggtgtgtcttgactttgcattccaaaataaaaatgactgatcttttccattagcacagtttgggtcagcctaactgccagctttcatgattgtatttatttattttccctaaggagatacgggcactttgtgggccttcccaggctgctgcaaaatgatggatggttgggctccgtctaatccaaatgacacggggtgtcaggagcattggtaatcgtgtcctgccgacttcaaagcccactgccaaaacatccacagcacagaggtttggcaacttcacataatcatagcaaaaggactgcaacgtgaaaaaaacaggccctgaaacagctatgaaaagggccagttcagaaacctattcagctaagatgtttcggctagcgccttcgcacggtcaccttgtattttcaccttttgagttgccttcacctggaccaaggttggcagcatttgtgattcaaagaaaagatgcccagggaaactgactctagattatggaaataaacattgtcttcaagggatagccagcaacatcaggctcagggctagtgaatcccaagccacagtgcccaggtaactctgatgtagcaggactaaagctgtctacctagtgagagctcctgaaagagaaaccccgcagcaaatctagacgttatcccttgtttctgtaaagtgagaaattgcagctatccatgacgctttatttgccagtaataatacagtttgccttacgagtggtagcttgttcactgttcaacaaatgtattttaatcatagcaggaattaagggtgatttgtgaccaggtgctgaactagaatttctcaatgacaaccccagcttcataggcctctttccattccaggcataaatatggaggctccaatgtgaaacccggggtccttctgttccaaaaggggctagaaataaaagacaggaggggaggcaagaaggacctggagaggctgacgccatttgggtgccaaacatcctatttccttggctctcccttgcacaagttcctggacaaagtaaattataacacaaaatccacaacattcagcacatgttttcattaagcaactttagtcactaaaaaaagtgcaaatgcagactcctgtataaatctgatttgccatgctaggccaagcttattttattacatacattctgcattctaagaactaataacttcatattgtaaacattaagcatacagagttaaaattcaaggccacattatatcgattgtctcttttgtcgtgtgtctttggctggccgagatcaactcgtagtgtataaatgcataagttatataattattatataaaaagggggaaaaacattgacttgtatacttcattctgacaaacgcacagcgttcgcgactcaaaggaaaactggaggccgcctacccaaaatgcctgcgtgatttctgattgtggcagccaagaaggccatctcttacctgaccctgtggagaacaaagcccccacataatgatgaggtcctgaatgtttctcttaaatatcagacaattccagttaaaattttcatttgacaaacaaagaaagagatgcgcatttttgtttctgaattctactacttcccctttctccattacgctgtgtcctttctcctaacactgggtttggtataacactgactgcatgaaccctcgagtctccataactcattgtacacagtccccaaatgtcctgagtccagtcttcattgcttgagaagtttctttcccagccctggtctcctccttctctgcctcttcctcctccttcttcacccctctgtctacaatcacacgctcactctatacacatcctcagtcccaccttttagttcatagtcccggtaatactgtaaaggagttggaaactttgggtcatcttcacagtttgagaaagctgacagctgtccatcaaacggaatgtatttgatttcaaccaaaacagcacatgccatgcagttgcatatcaacgtctgttgatgggccacagtctctctcgtgtcttttctcttgtttttgatatgtttctatttttaaatacaggtagttttccttaaaatggcattataaacggtatgttaggtcaaaactgtgttgtttctattgctttagtttcatcccagtttgcattagtgggattccaaactctactctaaagtttatacatttcttaagaccactttctttggcactttgtccttaagacttcatgcttctacatacactgtcttttacaaggtcagtccacagatgatatgtccatattcgtgacatttttagcatcctcctcatttctgtagtaagacttcagtaactccctcccaagagtctttggatctcttccccggcttccttccccagccccagtaaagcttttttcattcctcttgaggcacttttgattcatgttctccgatagagtttgtggcgatgggctggtgaatgcacgctgatgggaaaagcctccgccaggtctttagtagtaagtgcccagatgagaaggcatatggctggtggggagcctagtgttggggtatatacccccagttggtgaattccagtatgggtttggggcagcaaaaaaactggaagatgtcacggggagggctggagggtggggcgccacaaagttcatcttctgtgggtgggcgtgataggagcccatgtacgggaggtctgaggggtacttgtacagagatgactccggggggtggggctggagggcctgggcgatcccgtggaagtcgaacttgtaggcgtagcgcttcccatggaccttggtcatgatgttcttgtcatagtagtaacggagggcgcggctgagcttatcgtagttcatgttgggtttgctcttccgctctccccagcgccgggccacctcgtcgggatccgtcatcttgaactccccgttggtgccttcccaggtgatgcagctggagttggagctgtccgacaggagctccaggaggaactgccaaagctggatctggccactgcctaatgaggtcaggagaggaaggaaaactccagtgagcacaggttccaggggaaagaggctctctgtgatgacggaaggaggtgctattggtgtgccgcccacattcccttcaccaggcctgtccgtccatccctcagctgcaggggtgcggactgctctcgttccatggccacccacttctccagagaactgcccttgcctgaacagagccgccgcctcgcccacccccaggtatcccacagctgggtggactgaacggggtaccacgggccggcccccttgcctcaaggaaagaccaactccatgacgctattcaggcttcagggctcccgtgggattgggctgaaacagcgtccagctgcaaggaggcttggaggaggccagaaacttccttagcgctgcccctgcagcacttcccattctctctctcctgagaacatgccgttaatcagtcacctgcacaagcaggcttaccccaagctctgcatcaagggaacccgacctaggacgatgatctaacagattcaagacctagatggaatgcagcgaattcatatggggcaaagttcaggctgcttccatccatttctgacgtccttaaaagaacagccagatcaacctggtgtttaggggatgaaagagctatatatttttttttcctattttgtgaagcacaaagtactgttatgtggatggcaataatgacttaatgccatttatattggctaggtcaagtaagataataaaagttagatttaggaaatgaacttctaaaagtttatggaaaaaaatcgagaatggaagtaaacaccattatttctaacataacattttgctggcgctcagaaagcaattctgtgaaaacttttcctagaacagaattaacccactcaaaatgaggaagtttaggaaaaaaaaaaaaaaagctggctctttttcaaaccagatcacccagttccagtatttgggcaagcgcatcgtaacggaaaccagtgccttgcctgtgtgctgcaacgccaattgtgttaagcagcatttccagaagaaaaaccccaacaatgagtgattgcaagtccccttgggaagctgaatgagactcttcctttgtcaaagagatcacatttagctgggtggacaaagtcagaattttcttgatttcattgaaatcatacagatacagctttgttttatgaaattcaaagaaaaatctaggcacatcattctagctgctatgttacaatacttgaagatagtttatggctccctagaagacagcagcatgtaaatattgacagcagtatccgtaccaagagaagctaagctgtgctgaacatatttcagaagcttaagaacagatgggaggtgggtctttcctcccaaattccagttacagcactgccttagacttattaccaaaagattaccttttattatagtgtaagtaatatcaatcgatgtgataaaatgattaaagtaactttaactgacatctactcagggaagtaatatactgtaaaaatcaattttacgttcattttcttctaaatcctcgctagcctcctgtacatatcacccaacttataaactctgctttgcatgttggctacatggacatggatatttttgtgaatttatccatacaatagcactgtgagaaaggtcagctttttctgaatctatgctggaaagtgctcattttcagtctagcaacacatttgaaatgtattaacagcttgtagctcattgaagtggaagcctttgctttttcagaaccacatatacaaactgttcccaatcaagttttgttgcctccaacattttattaatatgcatttagaaaatacaaagaatggtatgagaaaaccatatggtcttagtatatatattgtaaccaaaaaattacaacttgaaaaaattccgtatatgacctgggaataggaaaaggcatggatttttgatttaacagtctaacagatgcttcaatataaacacatacggttgtttgaaaataaatattcagcgtcaactttctcccatagagaaagcaactccacagacctgccgaaatcacacttggaatctactcaaaccttggcattgcctcttagcaatttgtccctcacccatttctcttataaacgtgtgtaggacagaatcagtggacaaaagtgatctcatgtctctcctatttctgaagagttagaaagcaggggacctaaatttgtggcagcaaactctatgcccaaaggatggatgagctaatttctcacttgactattttacccagtagccataaagacatagggctcaggactgtgagaatttcaagggagggtctatagaaataagagaactgtaagcaaaattcatcagctttcaaaccttgaaagaaacctggaaatgcaaaatcaatgaatgtttaagtaaatggtagaaagagtaacatcatgtcaaactcattaattgttaaatttaatatttgtaacaaaattcgctgcattttgcagtgtgtagaacaaaatttctcactgcaagaattctcaaaaatgaacaatggttgttaaaaaattgtcagtggtaaaggaattattctcagtcataaaattttaagagcaatttttaaattcttattttacttccaaaacaataacatttaatgtgtgacgaggtgcattttagaatatagaatagagatttccaaacaagaatgcttagggtttaggaaagcctaaaagtggcttgggtcactcatgggccaaaccaggatttacaaagagaagttcttgaaagacaagagctttcattgagtagcatcaccacctctaccttaggactcacctttcttgggtaaacccttcagatctattttttttttttactctctcttaataacatccttgcgatgtcagtaaggaggaactaattttttcttagggtaattaccaaaataaaacatatttggaggtaaaaaacagtggcaagcagcattgtccacctacagagaaccctgtgggtgaaagggagcggctgtggcttttaagaagacagaggcactcctttaattttacagaggaaagtaatctcctaatattgttaaaagaaagggagagaaacagggtagcaaaggggtacagactgagcaaaaaagggggaaaaaaaaactaaacggtttacaaaccacagagcaaagcagagagctgcagagtgagtcagcagctgtgtctggtggaaacagcatcctggtgcaaagccctgcagccgtcagctgatgaacaagggcagtaaatacagccgtgaggggccccaccagtaccatgtggcagtggtttggggccactttctctagaagccaggggtggtgcagaagatcccgtgtgcatggcctggaccctctgcaaggcagcaggtgtgtccagcaggtgtgtcctgaatggaagtctctgccccgaggctcagtgaggctcaggcaccacttactggaggggcaggaaagcatggtggtagggagcaccaactttggagttgccactgcttcagctgaatcctgcctctgccctttgtgggacgtttggcaactctcgcagctctctctgcctcagtatcgtcatctgtaaagtgggggtgatggtaatagtactatcttgcaagatcatggtaaggatgaactcagtacttgaatggtcttgtcagaatttctttgggctgaaaatcagagtttaaggaaagataacactcctctcctatagccaggaaatgcctaaagaaagagaaatactgttcaattggcctattgaaccatgaagaagcttgaaacggtgctattcttgggctgactgatatcctctgaaagcttactgtgtgccatgcaccattctaaacgctttacatgtattggtttatttaatccccacaggaatcatgtgattagtccattggagaagtgacgaaattggagcttagagaggtagactgacttattttgcttagcgttggcaagggttgaaatccagactctaggctgccatgcttaatcactgcgcaaacttgctttcaggcctggtttatgcacacctctgtagcctcctcaggtcctttccatgttgtcccctccctgggggactcccactggaagactgcacactgccacctcctaacaaatgggaaaacatccctagcctggtctgtcgttctgcaagaggcaggatgtattttcatgtgcaccattgaagagtatccagttagcatcaaggaagcctctgaacataacccaccaaagctctttcattagaggaaccatgttagatagattctcagctgctctgatgggatgtaaaggagctgtgttgcttataaccgatccatgatatcagaatgcagggacacactgttctcagcaggaaaagtgatgtccaaagtacacatcaagtgaatatttgggatagagatgttgggatgctgacatcatcctgtgcattcatactatatgatgcaatctttccacttaaaatgatgaaaaggaatttgtattgtatgaagagcaaagacagcaatttttaagtgatgaaagatttatttatcagagaatagaaaaatagaatcaaacaggaagaagcattgtcattaatacaaagataaaagacattctggtttcaggggaaaagttcacatgagcacaacagacacaaacctaaagatagatggagagaaagtcaaattcatcagaaactaaatgaaataaatctttatcttaaagtcacttgcctgcaaatcaaagatgggatgttgccattttctccaggcccattaagaacagtcttaatggtatgaagcacagtcctccttccccaggcctgtgatgagtttccggtctccttgctctgagctcaggtccctctatctacaaagggcatccccgggctgctgggcccagggcatatgcagtgttcccttgtgaaagctggcactttgcttaggagcaagtgactcaggccctattctacaaacaagccaagcagtacctttgggctgtgacaacgtggtcatggacatatatgtttcatttggccaatgtgtgagtgcaaaggccagtttggtcttctttggtgcagcttgactctttcctcctcttccttcctgacctcagattcatcgcctgcacctaagcagttatgaccctgaaaggaaatccttgctttctattctcacagtccgcattttgtaagacctcctcttcccttcatacttagtcagtggcagagtagggcaagaaaacaaaagtagactttgcagacagagtcaggtttctaacctgacctcccttatcattggctgtgtgacacaggaaaagttacttaacttctctggacttctaattccttttctgtaggatggagatagtaacctcccagggctgttatgagacacagaagggaccacagacattctatggggggcattctgcgggatgggagctgtttgattgttatttcacatgattgtattaacattcccagagtgtttcagcttccgtcattttcttttttctaatctatcctgaacattgctgccagatcagtcttcctgaagcatgactgataataatcatctcaaaacatagtcattatttttatttgaatggttatatggcagagttgcaaatgaaaagctgagcagaaggctgagaagagaccacagcctcaggagcctgggctactagatgaaagccagcatgagcaaaaagggcctgtggctctgtgtttgggacaatgttgtaactacctgtgtccatctctccacggaccaaaagcaccctgagctaaaggactatatctcattatccttggcattcatgtatgcaacaaataattattgagcacctagtctaggccccaggctaactagttttctttagattttcagctgtgtaaaaaaaattcattgaattcattaacattaaccaaaatttaacttcaaaaatacagatgttcaataatgataacatttcgtgttttcaatgtgtagattctcttgcagggatgtacactgattaaatcttaattattccatttcgaaccttattttggcctcaacgtttaggaaatacacattccatcttgtgcttgcaatatgcctgtaacatcttggcatttgaatttgcagttgggaatatgcagcataggctatgaatttctgaagctggtgccagcacagctggttctgatctgaatacaaacaaataaaactatgtggttggcactgaaacactaggacaggtgacaaaccttggcaatgcactggttacaaatgggctaattaagaatctgcactttcttctagcatcgaagttcagaaacagaccatcgaagatgagcctgaatttgaagtcttgtggttgtatcaaggctctcttttaaaaaatactagttattttatctgcttgtataatgggttgaattgtgttccctcaattccctatgttgaaatcttaacccgcagtatctaagaatgtgaccttttttggagataagatcctaaatgaggtaatcaagttatagtaaggttatggggtaggtattccaacctgaccaatgtccttatgcaaaagaggcatttggacacagagactgacacacacagagagatgatgatgagaagagacacgaggagatgatggctatctgtaagccagggagagcccccaggacagatccctccctcacagccctgagaaggaacgaaacctgccaccatgacactctgatttcagacttccagcctccagaactgcgagacaataaactgttgttgtttaagccacctaatccgtggtactttgttacagcagccctagaaaactattacagcttggattaggttataatgttctttgctgaagctgaaatcttaatttataacccaacccatctttccattaaggcaaataattcagtgagacctaaaactaaaatctgttcagttgaaggaatttctcaccaataccaatttacttttcaaaataaccactgccaaaaagtaattttgtaagaagaaaatcatcagcagtttctcacctggatttgcaaggcggctacttgttggtccaagaatctgataaggatctacagcaaaaagaaacaaagtcaaatcctagacatagttgtaacatagtatgatgtgacttcagacataatgcctgacttaattgttttttcagatttcagagccgaaaatgtcctccaactccaaatcaactgcctccacctcctctatgagagaagatgtcacacggcatctcagatgtcttgctaggggactcctaattggtggcagggcttggattcaaccccaggatcctgacatatagctcaaggctcacaccaaccaatgatataaagagggcaaacatgtgccaagccccatcaatccagggccgtgcaggctgtgttgtttaggcatggaaagtaaaatctaaaaaattaatggatcacaaagaagcagcctgtgtgcacgtagaatttttttccctatttattgcatagttggggacgtgttttagcaccatctcaagtcacctcgcatgagtaggctgatgacttgggccctatcttatgtatggagctgtcgaaaagaggcaaacaatcatgttaatttccattaaaaagtgaagcattttagaaatgtgctgctgagcctgaatcttctcttatggttatccagacggcccctgaaacatacctaactgaggacgctggtcttcagttttgggcactgtggaaggagatggttgagcagctgaaaatccagaaatacaaaaggcaattagctataacagatttggtcactagtctttgatgttgttgcataatcattctatcagttaatttagttattaacataatagtctaactcagaagcatctcacggtaaggaaaaattttcctttctgatgaaatcaaatgtaaacactgtaacaaaaaaagaggacatttccaattatttaaaaaatggatacctcccactttttccaaaagtaaaaaaaaaaaagaatttggaatggcttaccaaacagattacaataaatcatagtctaagataaacacataaagggaaaccaccagtcaaataaagtaaagccagggatacttttaagcatggccaagattcaggaaaacaccgattatttaatgtgtactcaaacatcccatgaaacatgcatttgtgaaggttgacatacactacatcattcctttatttttgttatgaaagtcctgatgacccaaatggagaaagaatcactgcagtgaaagatcaattgtactcttgtcgtcaatggaacaaacccatcacatgttgcaaaatcacagattaaccacagaaattattatatactccatcaacagtcatccactgcctgtgacatgaaactcagggtcatgggagccaacactgtacctttcgactggggcgtggggtggccgtgaccggtccaggctgatctcctggggggctcatatggtaaatctgtaaagacaaataaattgactaaaagatcaatcatgtaatttttataagagatgctttggttttttatttgattttgtatttattagaataaactttgtgcaaaaaaatctggtaatccaaagaaatatcccactagatttgagttttatttacaaattaaaatttcatatattatagtggtctaaaattctcacccgtttgtctgaaaacttccattggcagattctcccagagctttccaactcttctaatttcctacaaccataagtcaagaccccaataaaagtttcttacaatctagttcatcctgcttccactgggactgatctacatctgtctctttattatcttcatgactcatccaaagcagagtctacaacttggatgaaccagcccatttttgtttgaggtctgttcctaaatcaatcaaatgacattcagcttctttttcttcttgcatctcctgggaagtgatcgctgccttatctttttatttgccagctgcctctcttagccaactcccattttccctttataatctcatcaatttatattaaatcagtcttatctgatctagtgattttcataggcaaatgtctcccatttctaatgttctaaataaatttagaatttctctaaaatgacctgcatgaaatgaattacaggactgaaatagtattgctcccacagcccattaatgatgaccttctgagcttaagcatatgccaaacatttctttgtatttataaagtcgtatcacttgtcctataaaccttcatttacttttcatatgcaaatttaataactatacttctgcatcctcagtgtgagttctattaatgattatcaaagctctatgtcatttcaagtttgtttcaaaaatatattacagaaaccttattataatactcttgctaagagtgcatagctaaggctatttctacatgcaatcttattacataactgtttcaaaattatgtcttcttggattgcttggtctcagttcaatgtcatgtgtcattctgggccaagtgaaggccatggccaaatatctcagcaggtactttgctgccagacaccaggagatgtgtacaaaatttcacttggagggtaggacaatgcaattgtttttaagcttctctttaaacaaatattttaattttgtttaaaaccagcaatttgatgggtcaatcttcaaagagcttgactgtgttgcagaagatgtgtctcttcctattttcatatcccaaagagaatagaaatgatgcgcaacgtgaaagtcaacacagaatctccttaatgtatttggtctgtttggctgcaagcatctttgctactagtgtggtctatgaaatcctacccttcagagctttggagaattagataatttttctttttaaactgatgttactcctctctctcagctggcatttttgcatttttggacgtaaatcttttcccacccagatcctcagattttcacatctcttgtgttggggttacacataggaattatatctgcagcccctaacaatttacaactgaacttcaacttaagtctctgggaacactctgcacatgggttctcagtcagttgcattttgtctaaaataaactggacagccagagtttcaatttgcaaattgtctcagaaagaaaaacctactcacaaggcaatcctagccacatctaacctaatttaggagcagaaaagcacattaactaaggccttctatttaccaaatgaaaaaaagcaagataatacagaaatacagaaatatgttctagatctctgtttctcaaagggtggtctgtggaccagcaacatcaacaatacctggtagcttgctagaaatgcagaatcttaccccagacctactgcatcaaaatcagcattttgtttattatctttttttttttttggaggtggagtctcgctctgtcccccaggctggagtgcagtggcgcgatctcggctcactgcaagctccacctcccaggttcacaccattctcctgcctcagcctcctgagtagctgggactacaggtgcctgccaccatgcctggctaatttttcgtatttttagtagagacagggtctcatgctgttagccaggatggtctcgctctcctgaccccgtgatccgcccgcctcagcctcctaaagtgctgggattacaggcgtgagccaccgcgcctggcctcagaatcagcattttaacaagatcctgggtgactctggtgcacactgaagtctgagaaagcctgctctagaccattgctcttttcaggaactctgttcctgcagatgatttcagaaatgctatctagagtgtgcaaagacaaactaaaaaatggttgaaagagttctagatggattgcttttacccatggcataagtatgctaatggaatgaatagacagcatcagtaggttagtcagatactaccttaaacataaaattgttgctcatgaaatgtgactgggaaaaaaaataaatgccgaactactattcccaaaatattttgaaactctttattcacaaaatccttcatatggtgtataaccatatcccatcctccctcgaaaataagtcgaaacttaacaccaaacagtctacttttcagccaagtatttgagacagttatatgaacaatgattcacatgttcataaacatattgccgcggaagataagtgggcttttgttttcttccatgacattctggtccaatgcttccttatcggctaccgatcacatgctgtgggcactaagtatccccctgtgggatatgacattgggaaacattcaactcaggctcactgagatgggggacagccaggggtgacttctttggcagctacaccatctcaaaaccttcgtagttctgctcttgactgcttgaaaaatcactcctctatgtatctttgctatgtgtcctttattgataatagagcatcagacttccaataagaatatattttacatttaattttcgctgatcatttcaacaccctctccatttctctttgactttgatcttcaaggcaatgaactcatatgcttggcagaagtgcccatgtaagggaaggctgctttctggcactggttctgttgttttatctgtaagagactgtgtttaaaaactgagctttatagaagtcattgcataggcagcttgggtgaacacagatgtacattacatcacaacagtataaaaaacagcatgaagctacaaatagggactcggctagtgctgaccactacacaccagcaactgtgtcgatttcctgggagctgggatcagcttctcattctgaatgagactcctcctccaccacacccttttgaagacatcactaaattaatacaacattctggctaccctttcctggagggctaagttcagccaagttttacattctcccttcatcaaactcactgaggaggaacgctctagctcttgccccacacaccccacaccgccaccccgctgcctacccgctttattttttaaagggcaagaatgtggatcgtggaagagctcatcctcattctgcaggatccacaccatatctgcaaagcaactctggaggttccctggctgggctggatgggaacagatgagatttgcctgctcttgaaattagatgctaatggggaacacaaattaggaagagcaagagctgctgctaagaaccaatctagaagtgtctgtgaaatgaaaaaaaaagtttgagtcaaccttaacataattaagttgctctctattttcctccagatcttcttaaaattctacatcaaagtttgagcatggagttttggaaacattttgcattcccttcttgcctaggtttgcatatccctgtggttatataagaactaagcggaagcaaagaatgcaattttagccatttgctaagatacaggctttacataacacctaactgagagatgctatgcagtagttgtattgtctcactatgcctagctgtgctgaaaagcactaggctgtgagctccaatggaggaataatttaagattccaagaaacccctgaagagcagcagcttcaaagtagaagcaaaggctgcatttgcaggcttaactctctaatctcttttgataacaccccagaggcatatcataatatatgggttgtcatggggatggaagaggaaaggatggggttgcagaacatcatccttgggatagaactgagcttttgcatgacctgctcctaagaggacaggcagggtggtgcactgtgtagttaataggggcttgcaagattctgtggatctgtttttgccactttttcccctgagacctcaaagggctatggctccaaaagaagtggattcagcaaaaaagaagggtgtttgtagaggaggtacagaaagggattctggtcgtagtaactgcaacaacgtgagaaacacgtgaaacatcataaaataaagtataataaaatatatatatatttaaaaaatcataaaaccacagaatgtaaaatgatatgcctatgggttgatactttatgagagtagagaagactgtctcaatgctaattcaacaaaggggttgtgaaagaaggtaaatcttgaatcaggaaaacgtgggaaaatactaggtacgggcatgcaaggaaaagggatgaggtttggacaaatggcaggtagtggtggtggcagggcatgttcacatgtggtcccctgtgaggtcagtgaacggcctcggccaattgtgcagggagactgaactgacacagcagcagcgagactgacctgacagggaagcagtcagggggctctggaataaatgatccacttgggaaggtgggccatgaacagaagaaaaggtagattgggggctgggcatggtggttcacgcctgtaatcccagcactttgggaggcagaggtgggcggatcacgaggtcaagagatcaagaccatcctgaccaatatggtgaaaccctatctctactaaaaatacaaaaattagctgggcatgatggcatgcgcctgtagccccagctactcgggaggctgaggcagaagaatcacttgaactcgggaggcagaggttgtggtgagccgagattgcaccactgcacttcagcctggcaacagagtgagactccatctcaaaaaaaaaaaaaaaaaaaaaagaagagaaaagaagataaaagaaaagaaaaggtaggttggggcagtaacccagggatgggtgactcacagtgggaagggaaggagggaagggtggtgaggaagtgctgggaaggtggatgcagcaggacaacacacatgtgtaggagtctctgcagaaagggtgcggaatgctgtctaatttaaccagtaaaccctgaacaccactgtctcctctatcagggactctataatgaaacggccaccatgcagagaagagacagattctggtctaagtagagttgttacctaggagcctggcttgcttcatggtcagcacaataacgctgaccagagttcggttccctcggatgtgggattagacaaagggtatggaaatgaagatcatggcacagcaaaccaagagtggaggagacagggatttgggtctgtatccccaaggaccttcaaagaaacagtcaacaatcacctttctgaaagtagtcaggtacccactgaccacagggatatcgtcagattcccagtgacctccctctggagctcgttcagctctgaaagttagtgatgcaaaagctcttccccctcagccatcacgacgttcattctccagttgcaggttcacagcttttatctccacaggagcagtcctttaaggttgatcgcttagcaatggatgacccgaggtgtataactagttcttatctccaagttcaagtccctgaatagggcctacagtaaatagtcctctggcttgttcagtctgctttaaattctttacaggtcagataccaatatttgtattggttctcataatcacagtagcagtggtcaaaacaggttatttcaggtacaaactgagtcgcgaaaacatacttgactagtagtggagctgtggaagtgtgctctctcccaggtcacgctcaaattatgggcccatggaagaccaccatcagagcggcatgggaggtgtctgagtttgccacccttgccttccctgggttgggcagagagggagtcccaaccaacatcctcacagtcaccctcttctccatccacctggatgggccataccttccaaatccaccatatcctaaaatgtgaaaacaaagcagctccaggacccactgtcttaaccaggtagcatcagtcagctggcttgtctgacagagagattgtgccaatgaatttggccagtgttgtgatcttttaacacagtttataatactagctcacaacccctggctttgcaactcagtcagaggcacctatgagatgtcttaacataaacaaacaaatacaaaattaaaaagtaaaaaaatttttaaaaccctagccaaatgttttggaaatagtttttatttttttagtttatatggaaatattttttaaatgctcacagaattacaaaatctctaaagcttgagtcaaacatgaatttctattttccactcgcaatacacgtggtggatgtctttaggaccaatcttgcagactctaggcactgggtcttgcccatgtttcaatggcctgtgaaatcttttacatgacagagatgacttactacctcttagtaccccttagctgctaagcctttccatcatgcttcccaggagcaagacagtaaactttttctctgacgttagagaagagaaaattgccagcctgaagtcactaggcagtaaccagggcagtgtcagtatttgaacagcctgagaagcttcctcattcattctctttagctccctgggcccccagtctttctcattagaaagaaagagtagttgccaagcctagatcttgaaccagttcgaactgagacttgtgtattccggatatgtgatagagtttaacatgaattctggaagcatgtatgaatatggagaaaccatcccaccaccctgaacacaatgtcatcagctgtgaggctggtacaatgatacctagcttatcgggctgatgtaagtcccagggagaggacaaatgctaaaggcaagctatacccttctgggaaatgccctctctccctgctcattattcgtctggcaaacatctaattcccctttgccatgtggccattcctctggaaagcatctttatgcctttcatgggggattgagttcctccccacccctgctcctacgccctgtattgctagaagtggttcctctaccataaaatctatcacattagggaaaacatttatgtgtacatatgtgtctctctggctctaggtcactctactgaaacatctagaactggaggcaaaacatttcggtttgttcaccatcataccatccgtggctggcacagaggaggcactcagcaaatgaacaaaccaagctgaatgaagaagtaaactttctgaagacaggaagcttactgaagcctggttcatctatatattcccagagtctaacaccacgcttggcactaatgggcacttgatagatgtttatttttgcatgaatggcatgtaaatttattacctaattaaatcatttggaggacaggcagtaagattcagatgtaaatactactggttgcatgcttctgctctgcaagactggcttcttgtgacatactgataatcggtcactgtgaatctggggagtgtccttgttttgtgctcttcccccgaggagggacagatccttctgttagttcaaaagtcggcctattcctaactgccaggcatccaggatgccttctttgcccatctgtctttctgaaaagctagttaaagggctaatctgctcttaattcctttagtgtggtctttgaatgaaatggtttgagtggatttagtctccaaatcaacagaggcagaataagactgtctgggactggcttcagctccgggatcagctctctttgtatcacgtgacttagggcacggatctcagcaggacatctgggatgtctctcaatgaagagatcacacaggggtgttttcgtacctggcctagttgtaattctttgcgtagcttcaggatatactgaagtatttgggaaaataaaagctgcaccccctgcagacaaaaggaaagacaaacatgtgaaggtcttttgttgtggttgtcgatctcaacatcagcgccaaatctacttttccctatgacaacaaagggaagagacctcctcaaacctgccttaacagagctccggagaaacagacaggtgcacctgtcagattctcaagatggaagtgaaacttggagccttggtgtactcctgtgccccgtttgctataaagcgttttgtgttttgattttataacttcttgatgaagccctatctgtgtccccctcaatcccacttcccactgggcaatctcgttttattaaaaaattatatggtacatgttttatttttcaacttgtataaaaacccataatatattttacagagcttttggaaagtagtatcaagcaattataagtatttagcctaagagtatatggattttattaataattaatccacatctctattcaaatgcattttccctctctctcttttgaccaaaactcatgctgttagctgagaaaattcccttttcatagttcagtccatttggaatttgttgtcttgttcattggtttcttccgtgtttaacaatagcaaaatttaatatatttggagcttttttgaaactttcactcaatggttaaagaactcataaataaatgtgaaattatcagaaaatgtgcatagctcaaaggtgtttcctaagaaggggaagtaacttcctctaagttatctgttatttctggccacaaggtcactaataggctgatgtgtgcaaccaaaattattgaaaaagtgtactaccaactcgaagcaggttttttaaaacttcagattaaaaagacaatgtgttgaatatagaagaccatgataaatgagcaatttcattgtaatactcaaaccgggactcactcacattttatattttaaaataaaatggtaaatattgggaaaattgcgtatttctatgtgagggctgatcgtgagttaactggctgacttgcaaggctttctggcacttcccgtctccctccctagcccgagtgattgtggagggtccctgcagctaacagagtggggtgagcagccggtggccatgcttccggaactctctccatcaggaaggagcagatggatgtgaaccaggaacacattcatccacagaaaacccagcctctgctgtgagcggggggcgagggaggaaggttagccaggatgaggcacggtgttaaaccctacttaggctcaggcaaaataaatacataactaagtcaaatgtagaggcaacggttagagatagaaaacaggcatttggttagtgactaatttcatattctccaaaattatagcagaggttccctctgaacaaaagctctcaaaatgttacagaaattccctcctgccttttgcaaacatacaaagtctgtaggaaaacaaatcaaatagcctaaaagtttattggaaaggaaaaagaaaattccaacttatcctagcaaatatttctttaagaataaaaatggaaaaaattaaaggaggttgctaagggcccttttatatcgaacatgcttttagtgtctacagagtcagcacagcgaatatattgggaccaacagaagaagactgtaatccggcaaatgtgagctaagttatggctaaaggcaaattctgcacgtctcctggttaaaaaggaaccctttgataatcaaagtggggtgcttgggaagcgctcagaaaaccaaagggcttcaccttcctttaggctgtggtacattcctaagtatccgaaagtattctgaatcatctacctgcgttctgtcttcctggcacgcgctgactggtttcccatgaaagcatgcaacctgtacgtaagaccctacgctcttgctgggaggcaggggcggggccagcattacctgtgtttctagcatgcattaaccgtggagagttttgtaaggctttatcaacatcatctgaagtcaaatgtggaagaggagctacaaaacaaaacaaaaagcgacatcaaaatgaaaaaaaaaagagagagagagaaagagaattacctttcttacaaaaaaaaaaaaaaaaaaagaaagaaaaagaaagaaagaaaaccgttcccccactcccacactaacatcatgggaagcttataactatttccagcaacctgctacttgttagcatgttaaaacctacatgggggcccgtctttaattcagggaagaagtggttgggatgccaggcaaagcaatggaggagaatttatccacctcactgtctgtcacactacttccttctcaccatgctggacgttgtagaaattaaagcatgcagcaaacattctggattcatgccaacatgccatccctttctgtcaggttaagccgaatcacatgatacaaagtgaaaacttcccttgttctgtgctcaggttagaatataaagtggggcttcatgtagctttagggagaataatccccctaattcctacgaaagagaagccttaatgattctatttcgattcggggtatcatggagacttaactaatgtgtgaccagttaacgcttcctttcccctttgacattccatcttcttggtcgcaggaccctggaggaggcagctgagtgttgaagtgaattttggcttctcctgagagcgctgactacttctcatcaggtgatgtggccagggtgttgctcccctaagtcatcacataccaagcatgtggctccctcggatccccagtgggaactgggcgagggcaggaggatgctgtcgacacacctggttgaaccctctgaagctcaggtcataagaaccatagccacagccatctatccttggaggaagggggagcttactctctctgaggtagtggagatgtgagagaaggatgtcggcgttgtagctgggggtgagcctctggaagtcgtccttggtcatcttgcacagttccttcccatcgatgttctggaataacaagatgttgacgtctggaaggccatattctttcaccgcccactccagccactgccgcacatggtctgtactccatagcgtaggatctgaaaggggtgggaacacattcagtcaattcctgaagccagggatcttcatcttggggtagatccccatccacgtgggatttctgaccagctgccttccacaagcacagcctccagccagcctccctggctacccaggagaacattttgggggaaagacaaaagctgcctcacatccatagatcattgtctttaaagtgaatagttctggaatcttgggattattcacatcacatgcccttgtttttgctcaatctaaagtttcctgtaggcataagattttaaaaattcttttttctcatttatgttcaattttatttatttattttaaaatgagtaagaataagaggaaacttcttttccttagaaaactactggtatatttatatatatttatatggaaataagagtaagccacacatatcaggaaggtgctaattacagatcacaacaacaacaaaaataataataacagtatttatgcaaaatactgaaaaatactgaccacagaatcggaaatgaaatatagatacaccaagactctagcccctcctatgagccagcgttcctcatagagagctgtcagttccagacttttcctgcagggtgtttggttttgcaattaaccagcacctgcaggagtggggttggtgagtggtttttgcattccacagctggccatggcgagcacaaacaccccacaggatgcaggccacgtcgtcacactccagtgctacctatgggacagggagagcagggcccgggggagaaggagcaggtgatctccaacagaaacgccagccgggatgtcctgtggtaaacaccctcagtggtagggtcttcagagtgtggtaaatggggcggctgctcccttgggccccgagccctgagagacacatgggcagggagttggagccctgagttctaatctcaccatttctccactttctggaccttgctgtgggcagctatttctcctttctgtgtctgtcccacctgtaaactaagagcactgatctcagttcccgggacaagcccttaggggtcaggcatgccaggatgttccagtcctcttgaatgaaagtcaggtgtgggagtcacattttagctaatactttcagatccttgtttgtttggtcccactaatattttaggctactcaagaatggagcatgtagtatgctgctgcaatacatttttaggtttgcagaggtaaaccgtaataatagtgagaaacagccagccagtcatacacccagagttctcttcctctccctccttccctcttccttccttcgcttctccctccctttcttcccttcagctacatagaagaaagaaattattgcaggtccagtagaatctacctttcccattccattctcctactgcaaacacctatcctgaagttagtagctagtggttagaagtaaccactatcctgaagttagtacgtgtatcactcctatacatattttaatatttttaccatttaaactacatatattgttttgtgtttttaaagttaacataaacgatatatgatttgctattggcactcaatgttataatttcaagatgtagccaaatgaattcacaaagatatactcaatcattaagcagctcttaggcctcccccatgtgaataatctcaatttatttagtgaatgtcccctgtccatctccatgcatacgcgtgaatgagtccgcattggtccagggcctggggtcctttctggaatcatctggggagactgaaaaactagtgatgcctggtctcccctgggagagtctgcttcaattaggctggagggcagttgggcatcacagttgataacagctcccccaggtgactctaatgagcagccaaggttcagatcatcttccctgggcctcactattccaagcgtggtcctccaaccgcggaagcatcagcatcacctgggagctaattagaaatgctgagtctcaggccccacccagacctgctgaaccagaatctacattttcacatgaaacctggggacacgctggccttggctgagtacctagatacgggatttctgagttacagggcacatccatcttcaacttgaccagctagcattggatgtctaccaatatttaaacacccacattctcacttaaaaatcagtgcacaggccaggcgcggtggctcacgcctgtaatcccagcactttgggaggccgaggcgggtggatcacgaggtcaggagatcgagaccatcctggctaacacagtgaaaccttgtctctactaaaaatacaaaaaaaaattagtcgggcatggtggcgggtgcctgtagtctcagctacttgggaggctgaggcaggaaaatggcatgaacccgggaggtggagcttgcagtgagccaagatcaggccactgcactccagcctgagcgacagagcgagactccatctcaaaaaaaaaaaaaaaaaaaaatcatcagtgcgcagaacctgaaaactaaagggaactctggttttgctacagagagaatatcaacaaaaactccaacggcagtgatgacagaaaagtgtacatatttatttgtcatccaaacacttggaaacatgttgttagtctgtgaaaactgaatgtagatatggaaggttaatgttatccagttcactgaagttcagatgactcttcgtcattggctgagaatttggctttcagagataaaatgtttcttttttcatgacatgtcagaattcctctttctacaaaaatggatcatactgaggtcttagggcaagttctctttacctttggttctgtgcagaggatagtttgttcagccctcacagagagaagaccccccatcctacccaagtcattccctgtaagttccatcctttgatgttagcgaaacccacctttttgttttgttttgctttgcttttaacaaaatgggaggactattttttttttaatgtaacaactgtacttcctagaaataagttcattctgggaacagactttcttctctaaatggtggaaccggatattctcaaaatgacacataaacatattgtctgaaagccactaggttcgtgttaaaatggtgaaaggagaagtttaatctctctattatcccttggtgtgccccttaattggtttcgctcatcaagacaagggttatcctggcccattcagttttcctttaagggaatcaggtgcaagaccccagagacaaagtcctcaacctgtattgtacttatctctacaagtctcactttgagttggtaaaaggctgttctggagttccggagttctgccaatatgagtataaattactacagcctttctgatgaacaacacaataatacaacaatacaacacaacaatacaatcaaacgtctttaaatatgtgcagattccctggcttaaaaattccatttctagaaatttatcctaaggaaataatagaggatgtgcgcaatgatttattgtcaaggatgttctttgtagtgttgtttataatagcaaaacattggaaacaccctaaatgtccagcaaaagagaagcagttttgtaatgcatttaggaatgttcctgtgatatttagagactaaaaattacactgttgaaatatatttattgatatgataaaatgttcaaagtagattgcattttaaagtttcaaaatattattatgatatcattgtattttgcaaagatatataaatatctgcacagaaagaaattcagagggagatacagcaaaacgtgaactgttgtcactgagggaaaggagatggggaattttagatttgtcattttcactaaactatattttctcatttttctataataaatatggaatacttgggttacaaattatttatacaaaatgtattctctatttttcaaagccaaaacatggtcttacaaaaggtatatatatatttaatgtatattatatgtatactatatatcacctatatataatatatgtgaaagtatttttataaaatactttaaatactttataaaaagtattttttaaaagtataaaaaataaaagtaaaaaaacaaaaagaaaagttaaaaaaatgaaactatgcaaagcattttataaaaagtataaaaaataaaactactaaaatactttataaaaatatttttataaaataataaaatatataatatatatagaatatatacttacatatatgctatatatactacctatatatagtatatatgtgaaagtatttttataaaattgctgtcaagagtataaaaagttaagtttcagtttcttttatattttgttaatatagactgcttcatctgaaaagagtaaaattacatgaagtcagaacactcccacatccttttagcatttgatctccacacctctgccctataaatttctaagcaaacaatggtgaaaacaaaacatggccactcggtagaagaaatgagggcattccttttctcctgagcactcgcaccactctcccagacccactccggaggtgttgcaatagaggacagtttgcaggggaaaaacccagattccccagcatgaagcacacagtcctttgttccatgggtgtcattcccaaccattccccctccaccctacatttcctgagccaatgcctccatgcctgtgccacatgccacccacagcgtgaaggactagcaccttcttgtgccctcacctacactcacgacctcctttgggcatctgtcctagatgttctcacagaggaaacacttaacaaatctctgggcagtgaagtgataacaagactgaagacctagtctctgctcacactgaactccacctccactactttggccaggcaatgatgctgcagctgtagatgatggtttttagagttcaggtcagtgcactgggtccaggctgtcaggttttggtcctaaccttttaactccatgaagagccccagtagtctctctagtctcctccacactccatggtatctcagcaaagctttatggcttctgtcacaccaggaatcaaagaaaggggctcatgagttcctatgagattcagcaggcctgtcttcctcctttcttgaccccaaccacacatgtgtaggaggaaggggaggggactacagcataagccccagccgaggcatcacctttgcctatgtttaggtgcgaccttctgccctaggtaggaacacctcttgtctccaggtagcagtgtgtttggaacctgtcatttaattttataactggacctcatttttctcttctgtaaaacaatgtggagaatttcaggacctgagaaatgactcgaataggataagaactaagatagatttaattcaagtaaaagtcattaagcattatgcatatggctatatgcaccagtactatggagattccaaagtgtccaagaccaagagaaacactaaggacccactgagagaggcagcttatgaccacaaccacaaagcagaactaagtctctgtgatcaggctgggcgtggtggctcatacctgtaatcccagcactttgggaggccaaggcgggtggatcacctgaggtgaagggtttgagaccagcctgaccaacatggagaaacctcatctctactaaaaatacaaaattagccgggtgtggtggcgcatgcctgtaatgccagctactcaggaggctgaggcaggagaattgcttgaatccaggaggcagaggttgcgataagccgagattgcgccattgcactccagaagcctgggcaacaagagcgaaactccgtctcataaaaaaaaaaaaaaaaaaaaaaagactccgtgatccaaggaggaagtggaagtgcagagaggtagcaccaaccaggaaaaatgggaaaggcttaccaggagagtgaacttggattaacagcgaggattttgacagaagtagagagaagctctttggtttaggggaaccacttagcccagcctcatccgacatgggcatgaaatatctgacatgtttaagaaaaagggagaaatttggtgtggctgcagtggaggatttcagagagagcacagcaacatacgaggatggggatgaaagctgggctcagatcaacaaggtccttgagtcttgctaacaaggttggattttcatttttagagatttcagagtaattgaaaatttctaagaaatttttaaaaatcttaaataacaccaatcacagaaaacttggtgatgaaaataaaaggctttattgggaatccaaatacccacattgggattcttattcaaccatttactggacgtaaacgtcaacctctctggaatttgttttatatttttctgtgggtaattaaatgaaatgttaggggaatagaaaagtaaatgagataatggatgtgaaagcactttgccaacaataacatactgcaaaaaaagaatgcatccacacactcgattttgcattgcaaactctgctaaaatggaataagaacaaaatctgttatcacaggggcagcctcctccttaagacacaaaagtccaatttataattttattttaagaaacttttggagatgcttctgtcagatgaatcataagccattgaagataagttgttcattttcagccttccattccaattgttttgaaaacatctgtgtcatcattctacatgtcatggacaccaaaatggtaaactgtcatggcacaggctaaacagaagccatcactctctgaagcctcttatttgtatcttaagttacatggttattatgaaatctactttggtaaattggaatttaaaaaacaaataaaagtaaaccattacacacagagttctggagttgtactgttaatgtactctgtatgtggagtgggagtgggggtataagcagtgggagggagggaggaaggctgacatttaaaaaaaatatttccatgaaacaggattctgacctagtagagttcccctgttgccaggaaaatattgagtagatatttaaatcaggcaaaggggcactgcatcgccaaagacaaactgtgcctttgtgaaacaaaatgcctcacacaggcaaacatcttctttcagaggcccctctagagaaatgaataaagtaagattaaataaaagccaaactggtgataatgaaagtcctgaatgttatttttcttaaataatatcaacgtaaaatattggcttcccaaaagaaaaaaattactcttggttatgaaaaaaacatcaaaaaataaaaactaaaatgtacctctaagccatatcacaagcctagtgaggtgtttgtttataaatccaggccctgggcaagtcagccaatctgctgtccaagacactcataagcctgcaaaaataagatttaacatcttgcatcctcaggaggacagaagttacatttataaagcaggcccaatagagagaactggcttaaatttgagcaatgattcactccatcacaaatggaaatttgatctcaaataaagagcctacctcaagactgtttctgagccttttaaatttctaacttatatgtagagttcatttattgttttggtattgatttctaattttattgcacgttggccagtgaatagagtctgtatgaaattaacattttattttattttatttttttgagatagtgtctcgctctgtcacctaggctggagagcagtggcatgatctgggctcactgcaacctctgcctcccaggttcaactgcctcagcctcccgaataggtgggattacaggcacccaccaccatcgtggctaatttttgtatttttaatagagatggggtttcaccatgttgtccaggctgatctggaactcctgaccttaggtgatccacccacctcggcctcccaaagtgctgggattgcaggcgtgagccaccatgcccagctgaaattagctttttaaaaagttccggtttgttactcttttggcggcctagtgcatggtcagtttttataaatgttccttgattgcttaagaaatgcatattctctaatttgggagtacagagttctagaaaaaaaactcttggtaaggtgtatttaattttaatgtcactgacctatcaattactgagaaatgcaaattaaaatatctcactaaattggacttgactatttctttttgcagttcattacatatttcaaggctatgttattaggtacatgtaagtttatcattattatatatttgtcatgaatttagccttttttcactatgtaatgaccctcaattatctccagttatgctttctgcctgaaagtatatttagtctgctttctatttctatttttgtcagctttttaaaaattcaattttcactagcgtatcttattctgtcaactctcaatctttgtttgtgcaagatttttttgtaaacaacccataactgattgtggagtattttttagtctagtctatcactctctgtctttaatggcaaatttggtctatctacacttattatcactgatctatctgatttttaccatcttattttgtgctttatgttaaactttcttagtccattctctatttctccttgccaagtgtctaatcagattgatctacttttcttcattcacttttttttctttgtttctgtattggttttgctctttgacattctagttctctttcctgttaatctttaaacaaaatctaagtttaattaccagtaatttagaaagcttatacttgaatcatccatctctgattttacatgacaatgttccctcatatttttactccactgaattttctactccctacttagggaggctgtggttgtcattttacagccatttctttctagatctaccctcaccttaatcaatttcattgctcccatttccttcctgtatctcactcccttcttctaggatccattttttaaattaaatcttttgttattatctgaagtgaggttcaattagcaacaaactctctttttaactccttcttttatgttcttccttaatatttaaaaagtttatttattttatactctttatccaatactttaattatttaaccttctgcttaatcatgttcattgtttctgttaaatcttggttgggggagatctctcttcagctatttttttgtaatttgcgggtggcagagtcatctttagcgggtctctatctgcaggaattctgtacagcgtaggttgaagacatgtctctccatgaagatttcgtatttacttctgccaggtttcccagattatcactagcccatgaccatttttctgtattaatttctcagccttagagttcctggcacacactgttgtgtgtatggggtggggactcgggtaatgacaggctcagttccaattctctgctttgtggaagctcaagatttcattccttgcccctagttgacctttaaaacccaaatctctgcattatagcaacctaggacaaccaggtgtcaacataagaatgtgctgctctgctctattctcacttttttccttattttagtccctaaggagttcattgcctttcttcccagttcagctgtgcatttaaaaggatgttaaactccatgcagcaattccaggtgttttgcaaaaggaatgtttctcaggtccttttatagtaacctctctattttactagaaccaagagccctctctgcatactttttacctatttactttgaatagttttcatttttaatgcagccatcatcctaactcatgttatgctttacttcattcatttattaattaatcaattgtcaaaaattacttatatgaattgtataatcctctatgaaagattcaaaaatggcaagaaagagtgcctgtcctctacttgtttgagaatctacaattctgtgtattttatttaaaaatacatgactaaattatttttgttaggctctaaacatagctttgtcattctgacacactgatttatttctctggatgaaaccattctcaagtaatcatcttgtttttggataatgatcgttattgttctttgttttcttttgttgttgttgcctcctgttattccatgacaacattgtgtgtgctcatcatgttttagaaatgcaatggcttgttccacataaaggtttctccctgcctgggttttctttctttgtcttctctttaaatgttgctatccccagagtttcatccttggtctacccctctcctctctccatatgtatctttgggcattcttatttgctctcatgtttgaactataacatgcatgctgtattattttcctagggctgccgtaaccaagtaccacaaaatgtgtggcttagaaacaacagaaattcatcgtctcatagttctggaggatcaaagtctgaaatcaaggtatcagcaaggccttgctccatccgagactgtggataaaatctgtccttggctcttctagcttctggtgctgtccagcaattgaatgttccattgcttgcagttgcatcagtccaacctctgcctgtcttcacatggagttctccctctgtgtttccatatcatcttccctctgtgtgtgtctatgtccaaatttctcctttgtgtaaggacaccagtcattttattaggctcaccctaatgacctcatcttaacttgattaaatctgcaaaacctctatttccacataaggtcacattctaaggaactgggggttaggacttcagcatatcttgtgagggaggcacaattttttaacctgtaacaggcagctgtttctgccagtctatatcttgagtccccagggcactctcacagatgccagacccaaatataaacagaagaactgcactttttatcccaggtactgtttaagcatgtcacacatattgctatatttaatccatatagcaccacatgaagtaggaattattatcatccatattttggtgatgaaaaacctgagaaacagcaagattaagtagcttcccagatcccacagttagtacatggcagagtttagaactcaagtgctgtgactcccgatcaaggactttccatcctgagctctaggcccaccacactgcctgacaggtgtcccagaagcatcttaaacacaggatgaaccaaactgaaatcacctattttaaacattttttttttgtatattcattaacacctacccagctgctcatgctaaatctaagctgtcttcaattccattcttctctttgactttcaagaaaaacagataacatcattagcactgtagaaatgtaaaaattagccctgggcaacacagtagattattttacaaaattccctctccacctcctttgtttacttaagtcttatttgaaaaggctgttgcagaatgtctacaacaatttaacaaacacattctctcatcccattcctgtgttctcccctgggtatttttgtcagcacagcttaggaagaagaacccagactgtggagtcagaaagaactgggttcgaatcctggctcttcaaatgattggctgtgacatatttggcaactctcttagcgttcctagttttagtttctttactgtcgagtgagaatgataatgagtacctacatcatagggtggtcgcatgatttaaatgagataatgccttttctacaaagtgcatgtccaagtgcctgacaacagtgcatatcaatagatagtagctgtcgttgctttttagaaaaatgacttgattttagcctcacatttaacccaatggtggtttcctcaaccgctattcagctgataactttaaaatacacataataaactttgatgttagcatttctattttagtgggttttgttatttagttgtttgagcatagcaggaatttaaacagaagattaaagaagcatgtcccatcatatcgacagagtggaagagatcctcgggtgtgttcagggacgtaacaaagaaagatgaagacacaagtcatttcaccagcaggttctgggcctgagaataggctctggtctcacccagttgtgcaagtgttcccgggaaagtcatttcacctctctcagtcttggttttctcatgtttaaaggaagactgaacttagaccaccaagaatcctgcaacccctgcgagtctgcgattcctgctagttagatctagattactgttaacttgataaatcacatttactctcctccacacagaatccaagtgctggctgtgttgtctggcgattgagaacacaaaagacatgatcatcacctcactaaacttacaatctaatagaacagacaggcttataaataactcacgctaagaggattggaaacataatatatcagccatcagggcttggtcggagggtatgttctattacttgttattcactggctttcaaagcccagtgggggaatgtcaatatttagggaggatcatgtggaaactatgcagtcctctaacactctgagaactcaagatcccttctttacatgaaatcagactgccaaagactcatgctgggtgtctgtcctctacctgtgctgagctattctctaatgtaactcagcgctcacagaagatgtcacaagaaataagctgttgaaatgcagtgctgcaactgtggcaggaagacggtcgatggtcaggtctatggccccagtggccccaaaagggatccttcttttaggattctacactatgataaacattgccttccctgtgaaacttcttttttgaaaggaaaaattatttccccaaataactcttttcattttggctgccaggaagctcaaagccatactagaaacttaagtacagcatcttgggcaagcttgtggtcaaaatggctgcattcttccctcacatgctcttggcttctcatttgtatttttaactgccttagcactgattcctaatttccatttgataagtcaattgggtataagcccatcagtagtttagttcacacggcacctcaaatcctttgcagaatatccacatttaagtaagtatatacatgcatttgagaatacaatatgaaacaaaataaagtatgataacaaaataattggtaagatgtcataagaggagtgattaatttgccagaggatcaagcatggctcccttgacagggcagattttgaagatgtctggaagaatgagcaagagcattccagagagggaaccgcagggacaaggacaccgggtggtgaaaatgcagcgcgtgagttggggatgtggcagaggaaaacggcagaggctgcaaagggctttcgaaatcacatcatcgtgggtataaatgaagctgttcttgattcgtcctgtcatagcaatctccattcctcacatgctctgaaatactggtctgagtcattcatttgagctctcaatcacaccttctcctgtctgtcaaaaactacttaccccacatgggtgggtcttagctacttctgacagccttcggtcatctcctcagtgattaagagtaatgggaactccatgaacactttctaacggaatagaaaggtcctagcacaggggtctgagtaagacacaagtcatgtagcttcagccacacatgtttggtgggcaagaaaaggtgattttaaatctcattagagcttttattcacggtgaatggaacacagtaagagtttaatgaatgaattaataatgaagaaagtgaagagatacagtgaagagaagaatgtggctactcttatctctgagattactgattattgcaagggtctatgctgaaagtgaattattttaaaaatagaagcagaggcatttgaaaaactcaacactttagcacctattttaaggaattaaaacagaaaaagaggccaggcccggtggctcacgcctgtaatcccagcactttgggtgaccgaggtgggtggatcatctgaggtcaggagtttgagaccagccttgccaacatggtgaaaccccgtctctactacaaatacaaaaattagctggctgtggtggcaggcgcctgagatcccagctactcaggaggctgaggcaggagaattgcttgaacccaggagacagaggttgcagtaagccgtgaccgcgccattgcactccagcctgggcaacagagcgaggctccatctcaaaataaataaataaataaaaaataataataaaaaaacagaaaaagagaaatctttcaaaatgctataagctgctaaagcgagaggtcctattgcattttggtcagcattttgcaacttttaagaagtgaatggagcctgtgccttcctctttgttagccacttggttagcacatctccatgttcacagccaacacctaaagagtaacagtaactactgcaatgagtgattcttcatttttttttggaatgttaatgtgatactgttaatcatttctatctttcctttttgtctacttgccttttctaaaagtgataaaccatatctttattaaaaataattcaagtctattaaagtaaaatttatatcttctatctagattagaacttttcaaccttattgtacatgaaaattacatacacaataagcatgttaataatgtaaaatttccaaccccacacccaggtttggaacatttggaagtgtgtgtgtgtgtgtgtgtgtgtgtgtgtgtctgggaaagggtctcactctggcttcctggtgggagtgaagtggtgcaatcatggttcactgcagcctcaaacttctgggctcaaagaatcctcccgcctcagtctcccaagtagctgggactacaggaaccaccactacacctggctaatgttaaaattttttgtagaaatggggtcccactatgttgtccaggctggtcttgaactccttggcctcccaaagtgctgggattacaggtgtaagccactgtgactggcaggaaatgtgtatttttaatcataaattttccaggtaatcttgatacaagtggttctgaccatactttgaaaaacactttctaggccaggcgtggtggttcatgcctgtaatcccagcactttgggaggccgaggtgggcggatcacctgaggtcaggagtttgagaccagcctggcaaacatggcgaaaccccatctctactaaaaatacaaaaattagcctggcgtggtggcgggcgcctgtaatcccagctactcaggaggctgaggcaggagaatcacttgaacctgggaggcagaggttgcagtgagctgagatcctgccattgcaattcagtctggggaacaagagcgagactttgtctcaaaaaaaaaaaaaaaaaaaaaaagaaagaaagaaaaagaaaaacactttctagtcaacctccaaattaagctcggccaaaaaagagccatgtaaccagcatgggggatgtcacacttgtcaggcccctcttattacaactggtttcactgaatgacacttgggtttacgacagtgtaagagactgccctgccctatgagagatcctcctagatttacagatactcgcaccaaatacatagataaaaaccagagatgggaattatggcctaaccagtaccctttgggaaggcacaatcaacagtcttgccagaacaacaggcacaaaccagggctgcccagaatgcctggtggcgctactggttgaatgctttgctcatgactccccttatcttccttaggacaaacagaggaacacatcttcctccagactcagaattaatagctggaccatcttttcacatttgctttctttttatcctgtaggcactgaattatccctttcatactgcctgatgatacctcgaagccaaataacacctaccttttgcaattctgcaatatttaaatgttgcaattaaaaatacacatacacacacacacacgtgcgtgtaaacctcactcctggttttactctctctgttcaatttttactttagtccattctccacattcctttatttttaaaaagtggattctaccgtgctctttcatatgtatctatgtgagctttcttaaatctgttctgaaataggaggcagtgtaaatatatcaagtgacagtctacatttatccttcagggacattttctagttgacactttcttatgggcttttttttgacactttttttatgggcttctttattaactcaagatcatgagtatcaaaaccagggttgagggaatcgcttctcaaaagtgggttccaggtaccagaacccaatctgaacacggacaaagccccccagctcctctgtggttttatctctcagtctccgtacagtacaaatttcctcatcagtgtttattagggccactgctatctctagtgtgtaaacatcggcatgtattgatgatggtacaaatgtttaggaataactgatggtttttttttttttcactcagctatccgtgtgatttgcattagtgccaagcaatgtctctaagtagtaaggtctatgtgaaccactcaggaccaggtctggagaattctttttgcacacatggggtactccgtgccccaaatctgccttagtgaggtgcctggataccatggggatggatacagcagctggtacagctgcctgaggtcctgcaacctcatggccacattggaaaattgtccagattgtgcaatgaagctgtgtgtgtgtgtgcgtgtgtgtgtgtgtgtgttcatctctgtgtgtgtatgagcacacatacatgaagcttgaccaataactgaaagactcacaacttgcaaaatcagccacaactagctctcttacaaacactattaactgaataactgcctacactggcgtgaagcaactgaaggagggaagagctgaagagaagagtactttgctccaaagaaaggaaacagccttcacatcaaagcttactataagccaatttgcagagctatccttgcatccatccagctaatatttgatgagcagctactatgtataaaaaatcctgggtgctctgacttcagttgattctctgttctcttccccacacaaatatctctcttattttctaaatactttccttagtgtagaaagactcaagtctggccctactgaaaaggatatttatgacatcaaagcatattgatggcctcatggaaatacagcctcaccagttagaagatggtaccaggcattacctcttacatctgtgattcaatgaggaaccaagcaaggaatcttcagtgcaggccccctcagatggattctctcatctttgagatctaaacactttgttttgtctcctttgaagaaattacattcttaaggaggagggcaaagggtgagatgggttagggggcttcctttgggtgtctacttcactttgttcatgcccagagagtgtctgggcaacacaccactgccctcctgcctctcctccaggcacatcctagccttcgagtttttcttatgtgccacacatctggagtgggcacctgggacatttgtgtttctatttttcccatccaacaggaacagccccctgttctgaggcacagcagcaagtgaggcagtctcaggcattcaggtgcattgtcaagatcaaaccaaatgcatggcctctgtacctgtcaactgcctttcagtaaatactaaggacggttttctccctttcgtaatctaccatcagtgtctcctgtaagtcttaaaaaatgctttgaaatcaggcacaaccccaaaggatggtccctttcacaccccactgcatcgaaccagctttacgtgtttgctgaaagtcacatggtgacagatctaagctgaaacctgggattcaaatccaggccagatgttttgcaaagtaccctgcactcctgaactcttctgtctagaaggtgacagaagcccactgggcatgatccaactcaggtaaagggaaagtcacaccatggagggaatctaacctgtttgccatcacacttcgcagatattaatttaggtgaccccaggagcaagggagaattgagtttgtgcagatttcacccatgcatgcccttggctactttgccaacaaggagtaacttgtacagtgcagctcagtggtgaggtgtccgttcatccattctccacctcccttaatattcactgagcacctcccacttaccaggcactgcaactggccctggagatagggcctttgtggggcttatgttccattcagggaagaggataataagaaaactttttatttttttatttttattattttgagacggagtcttgctcttgtcgcccaggctggagtgcaatggcacaattttggctcactgcaacctctgcctctctggttcaagcgattctcctgcctcagcctcccaaagtgctgggattacaggtgtgagccaccatggctggccagtaagaaaacttttacataaacatgcaatataatggcagaagggaatgaatgaaatcaagaaaaatcaggccaacaggagactggcagtcacaggtggagacgagagcaattccagacggaagtgctcaggactggcctccctgaggccatgacattggcacggatacttggtgaaggaaaatgatatggaactacctggaattaagggtttcaggctgagctgacgccaaattcaaatccctgaggcaggaccgcagggtgaccagatggctgaaacaagtaacaggagggaacccacagaaattgctgtaagcagctgagatttaatccaatgccaacaggcagagactaaaggagtaaggcagacctgcctgagtcctaacttggcctcttattagcctaatgcccttggaaaagttggtggacctctctgaacttcatcttcctcatcagggaaatcatgagaaagatgtccatttgcaaagattgcttgagatcacgtttctaaagcatttatccaaatgcctcctgtagggtaaaggttcactgactggtgactgttgctgttgttcttatatttctggctttaggtagcatgtatcctctgaggagctttaagtcattttttctattacctttagtttggctaaataaataagttcttgtcacgtctttcaagttcaagagctattcctttgggttggttttgaattatgtttgtggtaaagagttactctggttattagaatctgtattacaggccagtgatagctggaattttagatgcttaagggaacacgtaagacagccatataatatatggctcccacatgtttatttttccagataagagaattttaaaaacaaacaagtctatcatctatcataaatagtacctcatgaaggacaggatatttggaacaataatctccaagaagtggcaattcctccctagaaaggtcacctttcatagacatatacacacgtgtgcatatgtgtgtgcacacaagcaaggctgcatgtttgcctggacatcctctttctctctgtctctctccatacgtagtgtgtgtgtgtgtgtgtgtgtgtgtgtgtgtgtgtgtgtatttttctctatgtggcaaaataaagagctggggctacatactgctgtctcacatattttttaaatatttgtatttttaaatacaggtgtatttttcttgctttgctgtcgatccgtgaacatgtcctcatgcatagacctctgccagctcccatttacaagccctgctctggacaaaggagatgtgatcaatgccacaggtgggggagaagagctccctgaggctcagcctagccttggggaagttgcgatctgccgagggcagtgaagctgtgggcacctgacctgctggcacgataactctgcgctcgttcgtggtcatgtttgggggtggcatgtgcttctcctccatgtagctgccgtagttcatcccaacggtgtctgggctgcccaccatcttcccgcctttggccacactgcattcatcaggagagttcctggaggagaagaaatattcttccattataacagcaatcaaagagcatgtctccatcgacttctcacaatacacagagagaaccaaagaagggcaaggcggaagagactgggggagaaaggacaagtgtgaaaagccaaatacaggcggggtgccgtggctcatgcctgtagtcccaacactttgggatgccgaggtgggcggatcatgaggtcaagagatccagaccatcctggccaacatggtgaaaccccgtctctactaaaaatacaaaaattagctgggcatgcctgtagtcccagctactcaggaggctgaggcaggaaaattgcttgaatccgggaggtggaggttgcagtgagctgagatcatgccactgcactccagactggcgacagagtaagattccatctcaaaacaaaaaagaaaagaaaagaaaagaaatgccgaaaacaggccttgccttctgtcctcccgaaatgcatattttgaagccctaactcccaatgtgatgatattaggagagagagcctttgggaggtaatttcagtttgatgaggtcatgagggtagagtcccacgatgggattagtgcccttattagaaaagaaagagaccagagctcgagctctctctctctctctctctctctctctctctctctctgccatgtaagggcagagcaagaaggtggccaggccatctgcaacccaaggacagagacctcaccagagactggccctgctggtgtctgattttagacttccaacctccagaagtatgcaagctcgagtcccattgtttcagccagccagtctgtggggctctgtgaaggcagcctgcacaggctaggacagtgcccatactggctagatgcacagaacacgcacaagggaggcggaactaccacctggcttctgtttcttaagcagctcctcctgaaactgtcatgtcaaaactccatctgtgacaactgattggggacacttgcagggaacagtgaactgctctttgttctcgcggtgtgacagcaaacaggcagagtagacagatgctgtggggcggcaccagggacactcgctgctcagtgaggtttatcctggaacgacgttccttctcaaaacctcagaatgaaatcctcctgctcaatttcaaatccctgcagccaatctttacatatggagctttgaagactcacagtgttccaggcttaggtgtagacaggaagggcagggaagggtgaggactgacgctaggggaggcctcatggggagtggactccagcagtcctagaggacccttgggaaagggatagggaaggaactgtgtggatgcagagaggggtcagctactgactactgaccgtgggcaacaggtcacagggctgctgttagtaaggcagtcactgtcatttggataaagtcaaacctacctttctggaaaaagaaaaggaaaacattttaaacagtgagttgtgaaagctacaggacattggtgaaatcgcatctgatagggaaatgctaaaaagaaaatccagcttagggccaggagtggtggctcacacctgtaatcccagcattttgggaggccgaggtgggcagatcacctgaggtcaggagttcaagaccagcctgatcaacatggagaaacccagtctttactaaaaatacaaaattagctgggcaagtggtggtgcatgcctttaatctcagctactcgggaggctgaggcaggagaatcccttgaacctgggaggttgaggtcgtggtgagctgagatggcgccattgcactccagcctgggcaacatgagtgaaactccatcaaaaaaagaagaaaggaaagaaagaaagaaagagagagagaaagagagagaaagaaaagagagagaaaatccagcttaagcagaaaacagaaaatacatgtcagtgccttcttagatggttaacacgtagatggtaaacccagggtcactgtagctgagaagtattaatatttagggtctgttgtctaaggcggatttccagaaatgcctctcaggctctatccaatgcatacatttttttcatattccttggaatctgggaaccttcgctttctctagattttagatttctatcccagtgtttctggttgtgggatccacgccaatgaagcctcatttatctcctccacttcttgttagttggagttctgcagagaacttggacaatcaaaaaactatgggcttggcatggatgtgaacttcaagtctaaggaggtcaaaaccatctgaggcaggagcgcactttctgagtggggtgagatggagaaggtcattccacacctgaaagccatagctgggatgtggacaggaagggaaagtgtttgttcagcatgtgggaacttgaaaatataggtttgttctcagcatcacttacaaatgtgtctgaagcctatggagggatcttaggtgttggcagtgaagagggtacactgccatctgcggatggaggttacagtcagggtcacgcaggactcaggccctaacatgggcctggaatgcacagccctgcctgatggcatcctcacagctgtgctaacatgaaggaaattttaaaataataatggtctgagttcccatgaagtagatcctgaatatttccaccgctgcctacacatgcattatttcctcttgatgctatttttcctggcttcacacatttatctctaaaagacccatcctaatatgaaaacacagagtgtcttcacttagactgagtttcctattcctctggaaaattccatcagttgagtagagtgtatatgttttggtatatttgtctcaaggagagaagttaccagggaagagaagttagagggattaggttctttaggaaaaagactttgcccagatgatgtgagtaactcaagtaacaactataaaatctagacaacctttgttcagattcaatcattcactcatccatttagacagctgttatcaagtgccggccgtataccaggtcccatcaattctttcttctccaacaacgcagttaacaatttgaaaagtaaaagatcaaagagatgtataaaattatagaaacaggccaggtgtggtgactcacgcctgtaatcccagcactttgggaggccgagctgggcggatcacctgaggtcgggagtttgagaccagcctgaccaacatggaaaaaccctgtctctacttaaaaaaaaaaattagccgggcgtggtggtgcatgcccgtaatcccagctactcgggaggctgaggcaggagaatcgcttgaaccagggaggcggaggttgcggtgagccaagaccacgccattgcaccccagcctgggcaacaagagcaagactccatgtcaaaaaaaaaaagaattatagaaacaggggacattgaggattttgaacccttcagaccaacccctttttcattttcttttagttctttctagtttaattttcatatccgaggacaagaactctaggcatagatcacaagagtttctctgtgacattaaagtagatccttcaggctggttgcggcagctcatgcctgtaatctcagcactttgggaggctgaggcaggcagatcacttgaggctaagtgttcgagaccagcctggcctcccaagtagctggcattacaggcgcctgccaccacgcctggctgatttttgtatttttagtagagacggggtttcaccatgttggccaggctggtctcgaactcctgacctaaggtgatccttctgccttggcttcccaaggtgctgggattacaggcgtgagccacttcacccaggtttctcttgcaaattttaacagcaaaagagtagccttaacatgtttgggatctgttttgggagcttaatagttatcagtcttcaccacagcgaactgtgttgctggcattgtctccactttccagaggtgtgaactgagtactcaaaacacaaggggctggctccaggactcacagccaggaggaggtagaatgagacttcagtgcgggtggcccgaactctccatccctgcttcttaaccctgaacagaatgactccacaaagtaaaggcaagacaatgtcttttcaaaggtaactagatcttcatttcaggaaggcatcagggactccctgacccatacactactctggtttaaggtgtacactaaagcactcatcctgacatactctcctaccctgggactgttcattccctgaaaagcatgtgcatgacacaaacagggcacatatacaagatgcaaataagaaagaggagtgattcctggagaagaaaagaattttcagagatatctgctttacttaagaaaaggacgccaggcacagtggctcacgcatataatcccagcattttgggaggccaagataggtgaattgttttagctcaggagttcaagaccagcctggacaacatgaaaaatgtgtttacaaaaaatacaaaaattagtcgggcatggtgtgcacctgtagtcccagctactcaggaggctcaggtgggaggatcacctgagcctggggaggttgagactgcagtgagctgagatcatgctactgcactgcagcctggacaacagagcaaaaccgtgtctcaaaaaaaaaacaaaagagagaaaaaaagaaaaggaaattttatcacaattcagagaactgaaaagtgttcatttgaaagtctcactataaatacatttctagctctgtgcccaagaaaagatccacactgcacaaatgtgtgtcttgattactccactgcaaccccaccttcaccaggcattccgaggctcacacatcgccgggaaaaagttcccgcaaacagcttggtatgtcacctgcaccaagcgctgcccagcatagaggaccacgtgttctccattctcacatgataaggatttggacgttcaatgcattgttttattgtgcacatgacaaagagtatgctgtgcagggaatgaacagtcctgaagtaggacagtgtgtcaggatgagtgctgcaatgtacactttaaaccagagtagtgtatgggtcagggagtccctgatgccttcctgaaatgaagactagttaccttttaaacatacacatacttttaaacatacacatacttgcatatgtgtgttgcagcagttcctgagaatattctcaggctattcagcaggtgcctgtcaaacagataatcatttagtaaatattaaatgtatctgtctttttgtttggggtggaaatttctttattgcaaataagcgtggttcaagatattgctctcacagactcctttgaggacaaacaaaaatcattttgtctttttatttaatttaaatagttttgggggaacaggtggtgtctggttacacgaataagttctttagtggtgatttctgagattttgttgcacccatcacccaagcagtaaacactgtacccagtgtgcaatcttttctccctcacccactcccatgcttcccccagagtccccaaagtccactgtatcattcttatgcttttgtgtcctcatagcttagcttctagttataagtgagaacacacaatatttggttttccattcctgagttacttcggttagaataatggtctccaactccatccaagttgctgcaaatgccattttcttccttttcatgggtgcatagtattccatggtgtgtgtgtgtatatacacacacgcatatatacacatatacccacacatatacatatgtatatatgtacatatacacatatatgtatatctacatatgcacacatatacatatataatatgtacacatatacatatatatgtacacatatacacatgtacatacgcacatataaacatgtgtgtatacatgtatacacgtgtacacatgtacatatacacatatgtgtatatacatgtatgcacatgtacatatatacatatgtgtatatacatgtatgcacatgtacatatatacatatgtgtatatgtacatgtatacacatgtacatatatacatatgtgtatatgtacatgtatacacatgtacatatatacatatgtgtatatatacatgtatacacatgtacatatatacatatatgtgtatatatgtatatatgtgtgtatacatgtatatgtgtgtgcatatatgtctatatatatgtgtgtatatatatatacacacacacacacacaccacattttctttatccactcattggttgatgggcatttaggctggttccacatttttgcaattgcgaattgtgctgctataaacatgcatgcgcaagtgtctttttcatttcctctgggtagataaccagtggtgggattgctggatcaaatggtagttttacttctaattttccatactgttttccacagtggttgtactagttccatagtggttgtactagtttccatgctgttttccatagtggttgtactagtttacattcccattggcagtgtaaaagtgttcccttttcaccatatccatgccaacatctattttttttttatttttaatgatggccattcttgcaggagtaaaatggtatcaccctgtggtcttgatttgcatttccctgataacaagtgatgttgagtgttttttcatgtttgttggccatttgtatttcttcttttgagaattgtctattcatgtccttaacccattttttgatgaaattatttatttttttcttgctgatttgtttgagttgtcgattctggatattagtcctttgtcaaatgcatagtttgcaaatattttcttccactctgtgggttgtctgtttgctgattatttcttttgctgtgaagaaagtttttggtttaactaagtcccatctatttatctttgtttttgttgcatttgcttttggattcttggtcatgaactgttattctcaaatttacattttcagttccaggttctatttgtcacccacagacattagtcttgacagtcctatgcaatatgtggcatcaacaagagtaaacaggagctgggaagacagatacttccctctgctcacagcagcagaaattccacattagccagggggccccaagaggtggggggctggttcagaattctgagaaagaactgaacaatagcccaatggctgggatattaaaaagccagccataacacctcacaactccctagcaacacccttggggccacacagcctcaaactcctgagctcaagcaatcctccttggttcagcctccctatgaatagctgggactacaggccacactccttgaggagtgtaacctctgcagcaatctcacacttttccatggcatttggtcataactgtggtcactcacaggaacacagaaatagtgtaggaagacaaccaaacattcatgatggaaataaaaaaaaccagaatgctggtgtccttcttctagtaactggagacgtgcccaatgaaactggcttgttgagcttcaaacaataatctcccttaaacagcagttggagaattaagttctaatcatttaaaatcatgagcactgacttcttaaaacatactagtattctgaattaatgagaaaaggacacggcaaagaatatcaaatacattggaaattttgttaaatttgagttaaggagagaaggcagacacgttgctaagcccagttgggttctcatagggttactgaatcagagggctggaagaagccccattttcaagcccccagacatgactgtctggaaaccacttggatgaacaagagtttagcttcgttaacagttttttagggaggggcttcgtaattttcctctgcaactccagagttctatttataaatatgtatagtggttttaaatagccattattcccctacctgtgtgcaagctatgtgaagtttggggtggcttataaaaatacatataagacaaaatgataacataaataattaacagaataaaaatgaggaaacaagggccaaaaaggaattaagagatgaaagcagcccactgagtaagcttactatttatcctgctgaggtaggataccaattcaactctgagctttctactagccaaagcaaagacacaagtgcatctgatgacaaggtttgaggtattaataagctacatacaaaccagttattcagcagaaataaagctctccctgggttaagctttgagagtttttctcggggcttctcatgaagaaaactggattatgcagtaaacaatatcgttcccaacatctcataatacatctaagaccatcccgcaccgtgccaggcgtagctggtggcagagcaggacgctccctgcacacagtgctcacatgctgcagccacagaggatgagagacggcatgtccccagcctctcctccttactggctgccattggaaagatcagacctgtcagagaagtcaatgcaaaaacatgaaaaaaacgtgtaattaaaaaaggagaaaaccttgagagatgcagtgttatacatgcctctagtttcataactcccaaatttctagatttgatttgattttattgttttttaagagacagggtcttgctctgtcacccaggctggagtacagaggtatgattatagctcactgcagtctcaaactcctgggctcaagcgatcctcttgcctcagcctcccaagtagttgggactacaggcacgtgccaccacacccagctgttttttaattatttgtatagatggggtctcactatgttgcccaggctggcctctaactcctgtcctcaagcaatcctcccacctcagcctccccaagaactgggattgcaggcatgagctgctgcactgaaacccctaatttctagattttaaattcaaatttaccaacactaaatagggtcatgtttatgtctcccaagagcaccaaatgcactgtgggtaaacaactctttccaggcctcagttggttaatcttccaaccagtatttcactgttgactaatgatgagcatggctccagactctttccacgtgtttatgttataataaacatatggataaagcatttaacatggtgcctggcacatgaccacgccaggtgtcagctattgctgttagttcatttcatctgcacatctccatgacagaaatactcgaaagcaggagccttgttacagatgaagcacagagaggttggataacttgcccaagatcacacagccagtagtggaagaattgggatttgaacctagatagtcatggtctcgactccaagtacttcaccgccccactctatgcccttgcttggtaaatccgtgtgaggagtctttcatagacctaaagcaccattgaatggatcctcagaaaacttaatttcatcactattaagtattctaaaagaacatcttcagagtggccctgaagacagtcatggatgagggttacagacgtgagctgagcagggcagccacgaaggagcaaggcagggccccgtgggagacttggaaggtggcaatgtttatgtagagatataaataggttttgataagtttggtctaaaagaaatagtcatctcaatttgcagttaagcgttctatgcttctccccaaaacttcattgctgtgcccagcagggtgcatgttttacacagatgatgggcaaacattcttaagtgcaaaaggaaaccagacaaaaagtccccatgacgagacagccgagtgggagtgcatctgactctgactgcaggcccaaaaagatggaggtgaggaccaggacaggagctggaccactggggaagcagtcaatctaattttttaagattaaataaaataagtccaagatgaaagcctccttgagctgtcgtccatacataataccccttaaacaaaaaaaaagcggggttggtggtggggactaatattactgaaaaaacatactgagaaatgtaaaatttggtctttagtctttgaaaaacaaaataaacttggcatctgactttggttttctcacatcagagtctacttacagcgaggcaatttccgtcatggaaagaacccgcaatgaaatggcacagccgtggccattagcttgacaagcatggagcctcagcccttgtgagtgtgaatgggcctcatttatccaagaacggcactgaatacatcccagaggggcagccccaagctcgctggccacattaaatctgattcaccctcacttcagaacacttagcaggggcccactccttggagaaagtccaaggcaagtcagaatgtaattgcggaaatcaatatgtcttcttctttgagtcagtggaggcaaacccgctaatcctgtcgaaaatctacctattcttctagagccatcctccttcctaatcctctgaattcctcttgcacctggacacgactttccaaccccttgttctccatcacatgctggtgaaatgtccccgaactcttccaaagctttctccctcctgctaccagagtgctctcccccaaacagaaatgcaagctgcccatgtccaacctaacccccatcatggcccagagcccctccctagattctcctcagtgatctggctctggagcccctcaattcactcatttgtttagcaaatatctgtggagcatctttctaggccaagcactgccccaggtactggagttatatcagtgtctctattaacatggggctggcatttgagtagccaaagcccctctccccaactccatgtgctctgtgctcaaagaccacattccacatcaccccctagtctcttcccttcaggccttcacttttgctactccctctgccttcaaggcctatgaccacctgatacctgccctattcacctgttcaccacctggtacctgctctattcacctgtccatgctcacctctaggttctctacaagcctttcctgggccgccagagaggaatgtctcccttccaattgcaccattctctgtattttctcagtaagtgtctgcaggatgagtgagtacatttatgaatgaatcttccatttaaatattgagttccttatctcatacctgcagtgcaagagaaagcccctcgtgttgcagtcagaaaaccattgctgaccttggttgaccttagatgggtcacctaacctttcgaggctcaactccttcattcataaaaatgaatggatgctttcttgaggttgctgtgaggacatccctgagatgatgcctgtgaagaaagtctgcaaactgtgaagcactatacagattaacacagcaacatactgcatgtgcatggctgtgcatgcgtgtatgtgggtgtaaatgtgaggctttttgttcttggcaactgttcataactgtacctcggtgaactcttaggtaggtcaggaagctaaggtttactattgtgcagtgttcagcatgcaactgctttttggaatgtcactgtctttctgaatgttccttttggtttattaggttagttcacattaagaagaacttggtgaggaagccacatggaagaaatggaaaggctttctttggcagctctaccctaagagggcaaaggggtcagttctgcgagagaacccccacaaggaggctggcccgggacaagcattccaggcctgtctcaagtctgaatacaaataaatcccttctcaggtggttttcttcataaggatcctaaaagcatatacttagtcctaatcgactgagcaagctcctaatcaagtttcatagtgtgaatcggaggtcagtcaccacaaaaggtatttttaggaccccagacaaggaggggattgtctggagcgctgcagggtaatttgtgggtctgttttatttctgaatcagaggcagtggaaaagctgtttcagaccccatggctggagcagcgggtggagctcagcagtgattcatgtagaactccgggctcaaactgaaaccgtagatgtttgtcttcacagctgtgtgttatttttacccttactaaatattctctcttacacctggaatttcagcctcttcccaacagtcctgttccctcccccttccctgaagcagttgaagacaaaattaattaaaaagtcaccaccagctcaccaacagttagttctttgtccccttaaaggggctcgatgtttccctgagaaagtttcattatttaagtttatatttctctttacagccaaaaacgaatgccagcaagaccgtgttgcttttagatcttgaaaactggagggaaatgcaccattttgggattcatcatttgaaaacaaaatgttctgtagcataagatctctacaagcagttacatgacaaagatcagatgtgacatcttttctatcttgtgcacgtcttttaatttgtctgaaagactcctttttcagagaagaaaggattgagcccaatagccagtatggtgcttcatgtttttataacaggccaggtgaatcctggtaaccaaaacaattttactttctttttttcttttttttttttttttgagacggagttttgctcttgttgcctaggctggagtgcaatggcgcgatctcagctcactgcaacctccgcccccactgggttcaagcgattctcccgcctcagcctccgggattataggcacctggctaattttttttttaatatatatttttagtagagatggggtttcaccatgttggccaggctggtctcgaactcctgacccacctattatttttaaaatgtgattgttttggaaacacctggtgaggttaatgtaaaggtgagtgcaggtgaactgacctgatgtgataaagtaagatagtaataaatgtttctaaaatgtgtaacatatacaaaaaatcaaaatgcagttggcacttggatttggtgcatcttgtcactgcttgtctgacacgtggagagaaccttgctatccctctcaatgcaggaaagacgttcagcttcttctaagaagccctgagggagtgaagaagagtccaggcctgtggtcaaatggccaactttcactttcactaactttcacttgagcaagtgacgaaaacttttggaaactcagtggtcatccgtaaatgtgaataatcataataatgtcatctcatagatgtttgagaaaactggacaatatgttgtataccaaaatctattaataaatcatgtgggttttagaaatatgggttaatattatccctttcagggtctttttctcctgcccaggtagagttgatggtaccctcatatctgttattgctgggccctgaacatcgctctgtactgaatgtgtcttatgatctcacagaatctttttcacctttggtagaccatgagctcctcttagttccttttttttttctttctctcttttttttttttgagacagagtcttgctctgtcactggagtgcagtgccgtgatctcagctcattgcaacctctgcctcccaggttcaagtgattctcctgtctcagcctcctgagtagctgggactacaggcacctgccaccatgcccagctaacttctgtattttttgtagagatgggggtttcaccatgttggccaggctggtcttgaactcctgacctcaagtgatctgcccacctcagcctcccaaagtgctgggattacaagtgtgagccacctgcacccggccagcttcacttaattcttaatccatctccatcgaagctaacacagtccatgatgcagattaaacactaaatacacgttggtttcctgcagcatttgtcaacttcgacactagtgccactcggagccaggtcactctttggacaggtgggggtgggggctgcaggggcgctgccctgtgtactgcaggatgtccccggcctctacccaccagacaccagtaacacctcccagctgtgaccagcagaaacacgagcattggcaaatgcctctgggggccacatcacgatggttgagaaccactgggctaatgaattaagatccactgagctcaggcaaggaggcaagagcctcttgttttacctggtgtttattagagagaagttcctgtccccagtgtctggggtgatgcttaaaaggggcccttaaaggggcctctatgctcatgaggattcctagttatggtttgtccgtaccttgtttggggtacattccccaagccttggcccatcctcgcttcctcttttcctcatgccatatgtccaacccatcagcaaagcacgttaattccaccttccaactatacccaggatgcgactgcctctcccaccctcccttgctaccactctcacccactctcacgcagatgtctcccatcctacacccacattttctcaggaagacttcaacacaggagccagagaggccctgcaaaatctaagtaacactatatccctcctttgcctcaagtcccctaatgatttctgaactcaccagaaagtgaaagtcaaagtccggcaatggccccacgggctctccaaactcatcatctattactcttcttcttggacactaaacagcagccacgatggcctgcttgttgtcctcgaacacctcaagctgacctcagggcctttgcatttagcattccctcctcttggaatattttctgctgtttaatcacgggcattctccctcaactgcctttgcagctttactcaaacatcacttttttgtgatcttctccagccaccttctttagagctgccatccgcttcacgtctttatttttctccttagcatttaccatgatctaacctgctgtgttttcataagtggtctgatgtcatgaccatcttcactgctagaaagtgaacttagtgaggcaaaacttttttgtatattttatcactctatcccaagagactaggaaagtaggtgctcaataaatattcattgaatgaatgaatgactccacgcataaacagtatgtctaaggccctgatggacccagcagatactccctactttttctcatctccatcacatgacaaatggcatgttttttaaataacatctataaaacatcctgctatctgacccgaggctggagttattcatggcatgcaatgaatctatcccagagagaggcaaggcccagatagcattgtctctcgctgcacaggcccagctgggcaaagcgccaatgtggcgggagggaaggaggtatttctcaactcaggcaaggacttctggggaacaaccccacctccgcgtagatcctcccagatcattcgctgggtgggtcacctttacccagctgctgggctttctcatttttcatctccttggatcgtgcaacagagcagtggttctcagactaccaggcatcggaatcccgcagagggctccttcaaacacagcgtgctgggctgccacccaggtctcttccgattctagggcagggcctaagaagccgcatctcaaacaagctcccaggtggaggtgatgctgctggtcccggagcccacgctgagaatcaccacaccgggggaaccctcactcaacagaatcaaacatggcaatggctccaggtggcctgcagactgggctgaggggggactcacagcatggcacataaattgactgagttccacctgcagtgagcctccaggtgggcttcacgaaatcgccatcgcctgtggaaaggggaaggtgccacttagtgtaagctgcctgtgatctggctggcctgagctggggatgctcagatggaggaaaagcagcctgctctgcacagacctgccagcctgctcacgagaagacagtttgcttgtggaccatgagtgagcaggtgttacctcttggcttatcctgctagtctatcatgacttgagctttggggacctcacagcaaattcagggcattggtagggagctcacgagaggctgagcaggcgctgaaactcccagccaggcccttggtgtggatggcacaggaaaacagctggttttagtttggccacacactgacagttctccattgtgtgaacacttggggctttctggtgcgtgaggctagagtgaagaaagggagagggtggctgtggaccaccgaagctgaaaaatgatgtcctgtgtctacacaacgtgcaattagattactgtctgcaagaatgctgctgtttgatctggcagtggccaagccaaacccacaaggacatcccagttggctcgcaaagcagtggttcctttctctcctgtttttcttttattatgctttacagaaactctattataatggcaacagatctcgtttcaccacttgtatttcatttcaggagcttgtaagcacgttaggactgaggttttgtagaattccactattcggttgggaactaagtccttcctttctctcaaagcacatggcctttttctccgtgggtactggatggatagggatggacagagggcactattcccaagctgggtattctaggcagaaggaggtgggccatgttctggaaagacctaagctgcagagagtgcacttctcccgtggaggtgtctgcaagatagtcaggggccacaaaggtaacagcccacaagttctagccaaagagtaatatttgacttacgtaacttccccttggacttgacttcaagtggcatgtgcactacaggaaagcccattatgcataagctaagaggagggacaattagaagaagctattgggccaggggccaggagatgggctaactccctggcacagctggcctggggcttccgagtctggaaggatgcaggtgcaggtagtggagcgttgaggagctgcactcctggcggggctcctccagaggcaggcagccacacactgctctgcagcatctcatctgtgagcccctccgtggcagaatctgcgtctccgtgaaccctgcctctgccctggcccctcgagctgggctgacacagcccggtgctggttcacggtgtccaaaataaagcagagtgaatcacgcccatgttcccttttatggagctgcacctgacattcgtaaagagcccatagtgaggccgggcatggtggctcacgcttgtaatcccagcactttgggaggctgaggcgggtggatcacctgaggtaaggagttcgagaccagcctggacaacatggtgaagccccatctccgctaaaaatatgaaaactagccactcgggaggctgaggcaggagaatcgcttgaactcgggaggcagaggttgcagtgagccgagattgtgccattgcattccagcctgggtgacaagagcaaaactgtctcaaaaaaaaaaaaaaaaaaaaaaaaaagcccacagtgagtcagcaaagcctgcggatgggatcccaggcagtcctttgtctgccccaaggctgcctccaacctctggctgagatgagtcttagctccactgataactgttcagctttcttttcccccattccccttcaggaagcccgttggattgttaatagcagaacactgactcaccacttatgtttcaattctttcagatcactgagcttgagcagccccctagtgaacctctgacctgacacgccaccccctttaccacccgctgtccagtcaggctgagctccagcagcagcggtgaactggccccccagagcacactggtttggagatctaaaaagtacaatgggtcaccagtcactgatgagtgcagcatccctggaagtcaggtgtgggggtcagtttcctgtgtcaacttggccaggccgtagcacccagtgacttaatcaaatgctaactgaggttgtactgggaaggcatttgcacaggtagctagtcagttgaacttgactaaaggagatgatgtcagataatgtgagtgggccttgtctaatcagttgaaggccttaagaacaaagcctgcggtttccagagcagaagaaattctgcctactttccagcctgccagcctcccctgcagatctcagacctgcccactcccacaactgcattagccaattccttcaaataaatatcttaaaatgtaaaaatatcctataagttctatttctctagagaatcccaactgatacaccaggccagcacccagacacaatgccaggagacacactgagctctgggggagacgggcatgagctctgtatctttctcttctacaaaggggattagtgtcagccactcctctccctccccctggaacatccttgtgggtaggggacgatgacacttggtgactggttgacatctgtacattgctagatgcctcaaagcggaggcagcctctgcagccagtgttcctcccctgcctattacaacccagctgcccttttcctcaaaggaggcacgtaggcctggattgaaggcagatgaggtccaccttgttcccttcatgaacagcacctgccaaaccgacatcaccgaacccaccggaggacccggaggatgaagaggatgacatgatggtcttcactcggtatccacccaccaaaacacatcaccgatgctttaggagctggaacagcattgaaagtttatgacggcagcaatctgggcaatgttagaattctatgagccctgagagaggaactcttaaagttcccattgtttccttgaaagaaaatgtcaaggccgggcgcggtggctaacacctgtaatcccagcaatctgagaggccaagatgggtggattgagttcgagaccagcctggccaacatggtgaaaccccatctctactaaaaatacaaaatttagccaggcatggtggcggatgcctgtaatcccagctactcaggaggctgaggcaggggagtcgcttgaaccccggggggtggaggttgcagtaagctgagatcgtgccacttccctgcagcctgggtaaaaaagagcaaaactccatctaaaagaaaaataaaaaagaaagaaaatgtccagttcccctgaaaaagatgtttcccggaaagagaccctcagcgcagcaccagcctttcacttgcctgacagaaaaaccacccaagagctttccccagtctgctgcgctgagggccctggggcggaactgccctggtgtctttcttatggactgaagctcctggtgtctttctttcttatagactgtagccccttgcctggggctcagggttaccccaaactcccaacctgtacccctggggtcacaacacaggctggaaaagcttccccatgcctggccaggagggagaggagacatcagctaccaaggggcatcacaggctcacactaaggaaaacagtgtttgcacttctcccacaaacagaatgcttatttttttattttttatttttatttttttgagatggagtttctctctgtcgcccaggctggagtgcagtggcgcgatctcggctcactgcaagctccgcctcccgggttcatgccattctcctgcctcagcctcccgagtagctgggactacaggtgcccaccaccacgcccggctaattttttgtatttttagtagagacagggtttcaccatgttagccaggatggtctcgatctcttgacctcgtgatccacccgccttggcctcccagagtgctgggattacaggcgtgagccactgcgcccggccagaatgcttattttattttaaattcgggagtaacacagtgagaacaatagaaactttcatttctggagcactgttctcgcctcctcactcagtctcccttcggaggcttgctgaatccagactggccccaggccagactctcaaacaagggccaggacatggctcactctgcctgttgtccatcggaaatcatctcagtgcccttttgtctgagatgtttccttcctctctccccaccttccaacatccccctcctccctgcaggtgaattgctcataggtagaaattagcctctgcagaagaaaagctttagaaatgtgtcccggtcttagtgtctccgccgtgatcacgctggcatatatgggatcatatgaccccacccaaaacagaattcattcagtgtttccaggctgtgttccaccaactgatctactgcataaacactgctgcattctttagaacatgattaccctgcattcttctgtgtttcagaaatatatatagttaatgatcaacagaaacattgtatcaaatgcataggatttatgggtaaaaaatatttacatgtaatcattaatttcccacaactttggtgtcctggacccatcattgcattttctatccaggtccttctgtaactccaggaatgaatctcttgatgagattcaaaaatatttacatgtaatcattaatttcccacaactttggtgtcctggacccatcattgcattttctacccaggtccttctgtaactccaggaatgaatctcctgatgagattcaagatgggcctgcctcgagttccacttaaaggaccagtgcggtggcaatatgtagcatcagagccagtgcactttcaagaagcagatgcacagacgcaaactgacttctcagagtggaggagtgttctggcatctcccatctccccatctggcacgtccagccttgccgttgacattccctctaggacactgtgacttggcaccttcattaacaccacactaggaattgacgcaaccgtttccagacttataaactatgacacttataataaacctttttagcgttaaaacatatatgtaacaaaaaggccccattacagcttcaacagagtggaaaatgctcagggtgtggagtcaaacactcctggtttaaatccaaactctgattccatttaagtggtgatttggggtcagactggaaatgcctgatcacaggtttcttcatccatcaaatggggtcaagtatacttcatgaggggctgctcggaggactgaggggctactggatataaaagggctttgtacacagtaaagtttccgaaaatgtgagctgttcttatgacctgatggtagattatgcaacatttcgaagaaataatctgttctttatcctaagatttgatattctttttcctgaatatatatggggtattagatcataattgaaattaattttacttttcaaaactacacagaattcaacactttttgagggccagggacagttctgcatttggtaatacattttacgtgacagttgtatgttcatgacaaactcagggaagctaataattatgggagacactggagagggctttatgtgtaagctaagaggaggaaaaaaaaaaaaaacaaacagcaggcattaagagaagaggaccgcagagatcagagggtggggtgagggtggagggcagacaatggagatccactagcaaattcaagtggcttggacatacgccgcactgcctggccactagctgacactctccctttgtgaaaacataagacggcattattttccaggcaatcaaacctcagatgaattctgccatatgtgggcaaggctcccctcccacagagccctcgtgcctgggaaatagaattgaacacatcttcaaagagagttcttggtaaatatactactaattttacaaactccatcctctacacaaaccactggagaacacattttcccagcgctgtccaacgtcaccgttcaatggcctttctttctttctttcttcttctttttttttttttttttttgttagccagagtcttgctctgtcgcccaggctggagtgcagtggcatgatcccggctcactgcaacctctgcctcctggattcaagtgattctcctgcctcaggctcccgagtagctgggattacaggcacagtggccttgctttctaagtcaatctttagagaagcatgactgacttccactttgcctttgcaaaggataggaaaatgggaggtcagggagagaaaggggcggaagtctccttaccttgagccattcacctggctagggttacattccattttgatggtgaccctggctgggggttgagacagccaatcctgctgagggacgcgtgggctcatcttggaagtctgtccatagtcgctggaggaggacgcggtcatctctgtcttagccaggtgtggcgttccgtaggcacactcaaacaacgactggtcctcactcacaactgataaggcttcctgaatgcccaaagaaacacataattcaagacactccaacagacagtcatgtttcaaaaagttgttgatttcagagtcctttctaactgggaccacattttagatcgtttttatggtctccatttctacctttcagaagaaaaaagtagcttgtttttctttcctcgggacagtaagagttagaaatgccagcctagaaaaacttttatgcaggtctcgaagcatcccaggcttgactgtggcagggcagcagaatatccactttaatctcaacttaaggaagttgaatttcaaaggtcttagaagacatccaattgcatgtgtcactatttgacaaatgcaatctataattcaagcagacagggtacagagcggtcatgaggattaaaaaaaagaaatctgaaggccaacacctaagcatctggcaaaattgccacattcctggggattttgcggaagagggacttagaggaagacagagggatcaatggagcaccaaagggcaaccaaccaaagatacaaacgtttccactctaagttattagccgaagtacagtttcaagtggtgcttccatgatggtgagcatctggatgataaatgaaccaaaaaaaaaaaaaaaaaaaaaaaaaaagctgtgaagtatccagatgcttccaaacagcaggatgtttaaaatatctggatcactgacaagctcttttttccccttactttcaattaatatcttcgctcttttgcatgatttggtgagaagaaatagcaatttgtcattgttggatcaatcatttttcgtggttttaagtcaaacaagtggttagccaatggctatgtttatattctacagccaatgagcaacggcaagtttgggaaatttcaacgacttaaatgatggcttgtgctgcaatgacacagagctgttgtgatacaatccaattttggttcttataacagacaaaaagaattccacatgaatgctcatttttatattagtcctttggcatcctcagtattgacatcaactagtgagaagcaaaggctagttgggccacacatttttatttaaaaaaaaagaaaaagaaaagaactttggaggcagagcaggggaggcaggggagtgtgggctgcgcagacccttccagtccaaacttgtcatctccaaatgagaaatctgagacccagaaaggtctagagctaatcttgaatgagctggccatgatcaaccaggggattagtgatgggaatgacttgtgtattaccatctgccttctccttgcccccacagccctatgatgccctttgtgacatttttttcctttgggacatgtgtttaaattagcaccctcttccccttctctgagatgacctttacataaataagggtgcttcccatcagtaatcacaccctagaagcagcccttctgagatggagagcttcctctccacccagaaggatcagaatttttaggaaacaatcacccccaactccacatctactctgtcgctcgatcctccacctgtcccaggaccaagttttttccttagcttcccaagtgcacaaacttctttgccagacacacggcactgagaatcagcaaggaggaagaatcaaaacaaactcaaacctctgtctctcaaagtggtggtcaggtgtctgtgctaaagcaaaagcccccatcctggactccataagtatctgtagaattacagccctgtgacaccctgggaaagactaagcctgctgtccaaacagtaatgcaaaatgtaccaaagagtcaggtaggccagacagagaaccagaatcaggcacaagggaaaaaagtcatcttgaatagacagcaaaatcaaactcatcaacaaccaaaaatgatacgaggcagtgacacagaagttgacagtacagaaacggcatcctagatgttagggaacctgaaattcatggctttctcttccagtcacaattgagtggccaaaacaaggaatctaaacacatagatgtgggtttcaaagtaaaatcagcaccatagacttagtcatgctaattaagacaaaaattagaccttattaaaaaatttttgcaaaacagatactcccttcccatggtggcactggctagtgtgttttacaggctcagaacaggaaacagagctgatggctgctgcctctctccttcctgggcctgagactcgaccaaggctcgcaggggaataacacactatgtaatgttagctttggctcacccatgatgagaaacatgaacaaatgtgtgatttatatcagaaattggcgaaaacaggttatatatataagaaacaggctaaatttaaaattacaaactaaaaaggaaatggctgcaacaataacaaacaagcaataactttaaagtattagtatttctccaagataaagtaagcttacttctgcaaacaaagccaatagccacaaaaatgtagtgtaagtttgaataataaaaaaaagaccaaaatattagaactaaaatgaagcttaagtgtgtgtttgtaggggaaggaatccattctcacatctggcaaagcattatttcagcacatggttttctaaagaaagaaatcaaagttaattgagatcgatttaggaaggaaaaaaccctcagaaatgctagagatgggggaggcatgcctcctttttttgcatcttaaaattcttctcacagctaatattgcacaaaaatgaggaagggaatataattcagaatattgaaagcaacccctcagttgcttttgttcattagaagggaaaaattctgaaaataaggaagcttcaggataaacacttcaaaagaggtgaaatacagtccacattttgaaaagacagagcaacccaaactatgccccaaagactttgttgattgtcactcaacaaaggctgctgaacacctaggatgaagtacagctcaggaaaaggaaacaaatgaataaagaaaatctctctcacatacacattttgggagtaagaagaagctgaggggttttcacagacccattcccacaacagcggtcactaaagttaagtgctgctcttcagaagcaaaccaaggcacagccctgccacatctttgtcctcccacttgacttggctgttggcaggtttcatcatcccttcggttaaagcttgaatggacacacgctgctgcatagggccctccctgcctggcagccctgtgacttcaaaggggagagaggatctagcccagtaggattaaaaccagaaaaagagtgctgaacacaggctgctaatcaggaccacatgagttctttaactccagctctgggagagacttcctggccttgactgacatgtctctccttccctgcagcctggctcctcctctttataactagcagatctcacctacctacttacctgcctgcctacctgccggccaaggtaggcagctgccttagttagcatgtatagattgttattgcagaaactctggccagccacaaggcttgggatctgcttcagtggctttataacagagaatattttaaacgtcaaaatctggcagatatgtggcataatcatttcatatgcctgcttctatgttactataaaaagacctgaactttagattggtgtttgccaatgtgtggggtgtttttttctgtagctccaggaaagttgggatattcccatcaggcaaatggcaggctaccaagctcatttttaaataacttacgagaaacacataattctaagcaaattacccccaaacaaaaggtactactgtgttagtactgtagtattgattatttcatttcaatacggaatataccaataacacatgaggaccattcctttggattttggtcatgggataacagttccagaaatgaagggaggtcccaccaggttatatttcatattataactctaaaatatgcatctattttcaagtaactagagtacaaaaaaggatccaaaatacattagaacactgaaaaagaaaactaacaaagttgaatgcatactgacattttcagcaaagtatttcaggaatcctgatgcctttctataacagatgaatactttgcaagatgcctatttctcaaccaaagtattagaaaataaaggcccaaaattgattctaatttgtgatccttatagctcataaaaatattacattgttaatacagagaatccatcatacttaacctcttttgaaaatttgggagtggtaaagtgttgaaactgagaaaatctttaagaatggtcaggtgaatttcacatctggagtaagcaaaggcatccatggtcctttcgtggttttcaaaaattaggaagatggccagaactaggcctctcgagaattggattatcaaacccaccttcaatgttttcaagtcttatatgctataattatttgataattatgaaaaacaaatggaacaactaagtggaacaagaattgtatgatcatgatcatgcttaaaaaaaaaaaaatcttggttcgggcatggtggctcacccctgtaatccaagcactttgagaggccaaggtgggtgggtcatgagttcaggagatcgagaccatacaaaaatccaaaaaaaaaacaaagaaaaaaaaatagccaggcgtgatggtgggcgcctgtagtcccagctactcaagagggtgaggcaggagaattgcttgaacccgggaagcggaggttgcagtgagccgggatcacgcgactgcactccagccgaggtgacagagtgagactccatctcaaaaaaataaaataaaataagaaataaaaaataaaaaaatcttaaagaagtccttgctgctatcacaacacagtgtggagatcattcacttaggaagccagcatcatcttcaatcaatagcctactttttctgtcagttttaatcccattacaatccaatacaaaacccttccttaaatttccctcacatataaccacgcagaatttggtacatcacttaactccctatattgccatcttttaaccactttcataaatagcttatccaccaaataaaccaggttaccttaagcactttcatgcaatatcctcttaaattctattttgttgattacaagatacaccacttgtcacattttatcagctctgaaatatgaaaatgaaaggcttatcctaggtatcaggcagcatttcttcttctctgatggcagataaaataatgggacattttatatccaatgacatcttacattttatgaaaaatgatcatttaatccttacaattgtcctataaggtcagctgtgattcttgcccacccatcagaaagtgcgattagagaagtaacatcaacagtgaggatgaggcagaaacagggtttgtgtctgtgaatggaatcattccccaaggctgtagactggccactacctggctgttactggaaggaagaagttggattaagaaaagtcacacggtggagtgttttggtgcctgctcttgccatgagagatggaatcacctagagagagacagagagagagaggctggtagagggaagagacagaagaaagatgaagggataagtgtccagaatccctggatctgggatggaataaaggatctggatggtaaacggagagtgctgggaaccagtaaggacttctctaggtataccatgctcttctatgagcctaggggatgtgtagcaatgggccctgcatacagttaatcatttcttttgcaatggcttaaatcaacaaccttgttcttttctttgattaatcagattattcagacacaaagacatggccaggtgttgggatgtgttcattgcaggtggatgcctgccttctcttaatgagtactatgcaggaaaactaggacaggtaggagtaccatttataaatatgctggagcctatgccactttgggcggcctttagtggatgtctgcagacctaaggatattggaaatctatctattaggctgtcgcaggctctattgtttatagtttctcttcaaggcagcacatatgcagtagatgcttctaaaaggtctagtatctaattgtatttggaggaggaaaaaacaacacaaacaaaatagacaatgcacttagagaaagctctgctctcccaccataagcctgacaaagatactccagtccttcaggagtttttattctaaatgtgtgcacttttgcaattctgatgccaccagtatctcattaaacaagaatcttcatctgaccagtgtgtcttttatttacaacacacaaaaaagcgaaacgtggtaagtgaaagaagcttcacaaagctgggtatgatcatttttgccccttcttgatatgattttcttttcttcttaattcttcagagaaggaagtattaacatcgtatattaaatgcagcatctagctttgtgttcacgtttttctaatttaacacattgcaattttagtccttcaaaactataaaaaaaatcttggattaacctcaaaggaaaaatgtatgtaggcaaatgaagtccatctaaagagagtatttctccaatatggtatcacttcagtgtcaaataatttcaccactcacaacactagtccagtgctaagaaatgagacccagaactagtgtccagatacatttgcacatacagatatacaaacacatacacatgcttacatatgtacacatatacatgtgtgcatgcatgcaaatacatacatgcgcaaatacatatatacatacacacacatatatacagatacgcacatgcatatacacaaatacatatataagtgtatgcatatatgcaaatagatacctacagaaatacatgcagatatacaatacataatgtatatacaaaaatatcatacatatgtatacatattactaaatacatactaagataataaggagagatgaaaatctttatccttattatctttattaatagaacgctttagaggactttcagatattctttatctttaatcatatccactagggcaaatgttgcctaaaagatacagagaacctggcttcttcccatttcacctctgctccttcctctctcatcctagaaggtgcttttccctatgctcagcacatcccttcagaacagacttagctggggatccatcccctccatgtccttcagccaattttcccggctctggactcacagactttctcagggctctgagaaggcctggctggtgccagcaattctctttgcccacatacttctcccctggccttgcctttattcaaatataagcattttcagggctggctcctctgtatgtctgcctctagaaataagataatttcttaacctcaaatgcttgttggtgttcatattagccctaggactaagacatcaggtgatattacagccccatcataatgctataaatgggatccacaaacttctattacatccaaatgaagagacgtgtttttgtgagatgaatggattgtgtagccaacgcccaggagttccagggagtttggaaaataattgccattggcaatatgtctgcagtcatactaccaaagagcgtattattgcagagtttcaccttcaatccacataggcttaaatagggacttcctatagctaagcaacctatgaacaaaataagacttactggaaaatgaacgtttgcaaaagaaggagggagcattcaatctggaaagcagaaactctagaaatattgtgaaagattggagcatggtagaaaaatgttaaagaaagaatagttatgtccacataatgaaaattagatttaaatgagccttgggagatcaagaatgtcaaccaacatcattttaaaacaactctgttttctcagtgccatgcagaataaacctcgaatgcatttgaaaggacaatgaactgggactctttgccctggcaaatgccatttaactgtttaagaaacaacatgcctgtgatgtgaatagcttcttattttcttctttaaagaatcgcttttttggctgggtgcagtggctcactccagtaatcccagcattttggcaggccgaggcaggtggatcacctgaggtcaggagttggagagcaggctggccaacatgatgaaaccctgtctctactaaaaatacaaaaagttagctgggtgtggtggtgtgcacctgcaatctcagctactcaggaggctgagacaagagaatcgcttgaacccgggagggggaggctgcagtgagctgagatcgcgccacggcactctagcctgggcaacaagagaaaaactccatcaaaaaaaaaaaaaaaagaagaagaagaatcactttttcttcccagtaggcttctttccttctttggagatgagcaaaaagtataaaaacatctgtggaaacctcctgtttgtatgttttacattggaatgggtgcaaaaaatacactcactattcctttacatccttctaagagggctgtttctactcttgacactcaatacttgtttttgtttctctaatcactgttatacgttactcacgaatattcatcaaaacccttttccttattttttatctagttttaaataattcatttgagataaaaagaagtttttctttgctttttttaatcactcagtggaggatgaacatgaagctgtaccaatggataggagaccgtctggtagagcacgggagccagggatagggatctgaagatggaagatgtgagtttcaagctgggctctgcccttgctctgggaatcacctgggtaaatcctttaaccctttcctgccccaagtgtgagctgagagcttgccagaaatgcagattccgagtctccagccctgctgagtcagaatctgctttgtaacaacttccccaggtgagctgggtgcctgctcacttcaacaagtgctgcattatccttttttgactctcaatttcttcaactataaaggtggtactgatggcaaccagctgccgagcagctctctcccaggacagttaaatgggccaaataatctagtgtgtgtaacaggtttcataaatcttaatattgtatttaaattatcatatgatagaagggtgatgtgactgactccaaacctctgcatgtgaaccatcagaattatccattctagtcatattattctaacaagccagatgcaaggaaaatcacagtctcttgtgtgcaaattatcacttattttttgtaagtactggattttcaaaccaagtatctacctaacagaggggaagggagatctagcatcttttacttcaagagcacgtctgtcactttgatttatagcctttttggtccctggtccagttcttttgtgggttttccattcaaattctacattagtttgtttaatgtcaattaaatcaaagctttgtgcaggaaggaatgaatcctggtacactccccagcgtgctgttggtattctctacataacaagataataaattaatagatataccatggtcttataacataatgttctttttctttctttctttctttctttctttttttttttttttacctagaatagcacaaggcacaaagttgatagccctcaaacttctgaagaaaagtcttttcttccaggatgtggaatccataatgctttctatgttaactttccctaaaaattgttgaatttttcataaacttctatgaggaagtgtttccatggcagtctggctaagaggttcacaccatcattctgtcctggtgatttttgaaacttacaagcccaggttgaaactcaggtgattcaaggcttgagaaacacaaaggccaagctcaaggagtagcaaagttgcttgcactttttttctattggcatggtccttctctgaacaccagggaaggggtggtgcaccacctctctcctcttcagaaggagctccgtgaaaaatcggcagttttatgcttggccctttcaaaacacacaaaggctaaaaatacagtgtgctacgcatctggaatgtgtctcatctgtgaatctctgacacatggattcattgttttcgataaaattccaggaattttattcatgagaaaattctggcacaatggaaaaccctggcaagcaaaagataggggcagcagatgtcctggcctccacccacaactctgtctctgcttttagctaattttcatcaggtgtcactctcatgccttcaaacactcaattcaaaatttcccataagacgggggtgagggggtgggggtgtcaaaacagccttaattttttaaataattggtacggtcccccccctccccacagacaggtgtgtcacaccaggttcaacatgcacgtgccaggatgcaggatgggcactttaagaagaagccgcaagaccacagggccactggccatggggctccaccactccgtgcccctcatgtaccaagtcttcaagctcctcgtctaaaatgagggtctggtctactgatgttttctaagactccattttgcaccaaaatgagatcgatttgtttaactagtaacatcctctttcagccatagccaggctgcagtctctacctcctccatctctgagcagacatgcagataaggtagaaatctaccatgtatggagttgctaaaaagttcctatgcatccaggttagatgctaactgcagggtctttccctgctgcccccagactttaattttcctcaatcttgtaggtatctccttctgtgctaatggtaagaagctagtcagcaccctgagagctagtgttatgtttttaagtgtggaaaggatctactctcttgcatgggaatatggcatctgttctacacataaagcacttcaataataataataaataaaaaaatttaaaaaataaaaaacacatggcaacatggtaataccaacagaaagtcttgtagaaactggggttctggcagacagaggagcacatgaataagtctccactattcacatgatggtccaggggtctccttcttttgctttctatccccatccccatcattgttggcatgggccacacactgtataacgcagacatgaacacagacgttttctttttcttagacgctgacttacgtagaaagagttagtcttcacccactgtgagggtccaatccctgccaaggtctttcttcagcttggtaagtgatgatgtctgactccctggggctgggatgctaagcctgtgcttttcagaagatttttccagcacataaatatatcctggttgctgcatggaaaggggactaagtagccaggtcatcagagccctttgctaatgttatacgctgagctcatgcttttcctatgacatagatgagcactgggtagaccccgtcctggtaacacttttcatgcactaacaagttggttgccagtgagacttgatttttatgactctgggagtgctgacctcaaaacctaatacatttgaactaggagagcaatccctccaacaatttcaaactacacatacttacatcacatccaatagggctcttttgccatctggcttgagcccctctataaatatgtctactttgaaagtcacaagcctgggcggggtggctcacacctgtaatcccagcactttgggaggtggaggcaggcagaccacgaggtcaggagatggaaaacatcctggctaacatggtgaaaccccatctctactaaaaatacaaaaaattagctgggcgtggtggcacatgcctgtagtcccagctactcaggaggctgaggcaggagaatcgcttgaacctgggggacagaggttgcagtgagccgagatcatgccactgcactctggcctgggcgaaagagcaagactctgtctcaaaaaaaaaaaaaaaagtcacaaatactctttgaaagtgtgcagagtcattcatatccaaaccatcaaggcctgcccaacagcctggtgacttgaaatcttgacgtgtacacagagtctaaacctcggtctttagattgcctccttactggacctctttacttattaagattcatccttgtggaggaagtgaggtcatggatgttcacatctatctttcccaggaagaaaaggaagcttcaagagctgggaaatgctatgcaccactgtgcaggttctgagcagcacagagccacctgtggggtgggcgggtaggtgagtagtggacatctgaccaccaggcgctgtgcaggactacctccttgcagagcaggtggggccttccaagttgcctactcatccaacctgcacagtaagccttatgggagcgtcatggggctacgcctacttcaaagagcaacttagctaaagggaaagagaatttgcacttgctctcttccactctagcagacttgcacttgtcgctatttatttgtgaacacagactcattttagattgacttaaaaataaaaaaaagtgcaaagaacagggcagctggaagttgggaaaccacttctgccactgctgaatctgaagccttaagctcctgaactggaaaaccagccgactggagcactgagctccctgggccctgtaaaagagcacactggccaggcatggtggctcgtgcctgtaatcccagcacttttggaggccaagacgggcagatcacgaggtcaggagttcgagaccagcctggccaacatggtgaaactctgtctctactaaaaatacaaatattagccaggtgtggtggcgtgtgcctgtaatcccagctactcggtaggccgaggctggagaatagcttgaacctgggaggtggaggttgcagtgagctgaggttgcgccactgcactccagcctgggtgacagagtgagactctggctcaaaaaaaaaaaaaaaaaaaagaatgcaccaagtagtggccagtcaggctcccatgggccttgacacgtgagatgtcaggcagaatttttattaatgaatctgatgccaattcagtatttctgcaatcacaatgcactttcgcaatatttatccaagcaatatttatccaacaaaaatatccaatatttatttatccaggatctcgcaaacgttcagtctagtttcactcacgtcagtgtctctaaccttcatactttgctttcaagcaagagtcgtgtgttggtctgggtgtccgaaggtgggggtggtagctggtgatgcaaggaaccaaaaattggccatacttacttacttaaatatttcacagctctttaacagattctcatctcctgctctcttctcttctccaaccttgccgtctggttctgacactgtcctgccacgattaggagtgagctttttggggttccctcaaacattcactcccagctggtctctttgttacctactcaagagcagttcatactgttggccactctccccttttttaaccctcttttctttggcttccatattcctgctattcctcctatttggttgacaattccatcccccatctctttatgccctcctttttctctcctcattctctaaatgtcagctttcctctgtgcactctcctgggccacttctctactaggctatcatttcttccaagccatcactcaggagccactccaatggcctcagcgctgccaggaagcgcagcgcatttaatttgaagggtgaaactgccttggagggatggcaggtgcatgcttaataacttgtttcccaaggccacataagtgtcattactggatgataattatcagctcaagagggaaagttctaagacagagaatgcaagatttctaaacaggtctaagacagttttccaatgtaagatttattatgtaacagttttgaaagtagtgtctgattccctgtctatatcctccagaacaatctgagggcatggttgccattacaatttactttgggggacgattttatagcacgtcttcacagacaacacgacaaacatctttgcttctgctacactgacaacctgaagttaacatttctgtacctatgtagccattttaatcaccccctaaactggttattccacagcccaggggtgtgggactgagtcagatgggctagagatacctttattcagaggatttagaagtttgcctcagagaaaggccatttctagtctccactagaaatcacacatatcttccaggaataagaatattctcttagtcataagttcaacaaatatgtactgaacaccttttctacttagaaacttgtctagctgcttctagattacatccatgacccaaaaccacaaagacacctatctgcataaggcttgtattctagcactacaagccacagataatttttgaaaatcaattaatcaaccaataattgatagggtaaatttataaccttgtttttcaagcctgatctcagggttagaaggtggtaagtgataagtatgaagaaacagaaggcagaactagagactcaggaaaagagaggtaaactgctgcttttcatttagagtggccagggtggtcctgagaaaacgcgaaggaggggagggtgtgagcccccatgcattcatgaagaataggccttccagccttggcaacagctagaacaaggccagagtggactgcgggggctgcacgaggaacaatgggaccaagaacagccagggaggaggggttactggaaaggagcgaaagaaagaaccaggaggtgaaccaggaaaggctgggggtggtagagccttgcaggccatggcaggaacctgggtgttgactcagagagaagtggagtctctctagccgtcttggctaaaagcccgggaattgtcttcttctgtgttgcactaatattttccatctcataagggttctgcaaagaaaattctttctatctttaaagttttattattttcaaaactaaatgtgatgagaatgcatatattgcatatgccatgtgtacaccaaaagccacacctaataaaatgttacagccatcctttgtcccacatgcaacgggaacttccattcatcatcacatgcagaaactctgggaactgagaatctgtacttttcattcagagtctgcaaggggtcacggccattttgaaaggctttgactcacacaggaaatacctcactgaggctcccacccacccatccactaatagggcagcctttagggaaactgacttgtggcaactgaaaggaataacggcaccaaagtattcccctgccctgaaatctctgtttacctgtggaccggtgatgggtgtgaggctgtaggttttaacgagctctgaatggcaaatggcagacaatggtgtcacttcctttctgcttaggaaggagacgtttggaaaaactgttcactgctgtgcttgcctatggagaacctggattcccagagctctatctggtagaacgtgtctccatattaataagcagtgaatcctcttttgcggctgaattttcctcaaggaagcagcatgggccttattactgccttaaaacccaatttcaatattcgatacatagtctgtgtattcatttgctagggttgccaagacaatgtaccacggactgaggggcttaagcaacagacatttattctctcatggctctggaagctggaagtcagagagcaaagtagcagcggggttgattcctcctgaggactccctccttagcttgtggatggtcatcttctccctgtctcttcatatcatcctccctctatgcatgcctgtttctgagtccaaattacctctttttataaggacatcagtcccactgaattaaggaccaccctaagggcctcattttaattggattacctctgtaaaggccctacctccaaataaggtcccactctgaggtcctgggggttaggacttcaacataactcagggaacactattcaacccataccatcctccaggaaggcagagaatgtgtccctcttcttcactgctgtatctccctgcctagcacagtgccaggtaccacactatgctctgtaggtcagtgattctccggagctctgtaggtcagtcattctcaaagtgttgtccaggaaccccctggggtccccagacccctctaagggcaggcataagcagatctgagaatccagctgcctccaattagcccagacattaaagagattgcaaaaaatgcaaaacaatgccacttctcattaacattttcttggaaaatagagttacttttcataaaaatatctcatttgtgttaacatgcaatgagtttatttatttatttttattttttgagatgaagtttcactcttgtcacccaggctggaatgcaatggtgtgatctcggctcactgcaacctccgcctcctgggttcaagtgattctcctgcctcagcctcctgaatagctgggattacaggcgtgtcccaccatgcctggctaatttttttttctttttctttttcttttttgagacggagtctcgccctgttgcccaggctggaatgcagtggcgcgatcttggctcactgcaaactctgcctcctgggttcatgccttctcctgcctcagcctcctgagtagctgggactacaggtacccgccaccacgcctggctaatttttttgtatttttagtagaaacagggtttcatgatattggctaggctggtcttgaactcctgacctcaggtgatctgcctgctttggcctcccaaagtgctgggattacagtcatgagccactgcacctggccttgttattgttatttttaaatgaatttataagtaaatgtttcaaaatttctgtttttgtttctaccaatagatataatgcatatacacaatttttttttaagaatcctcaaccaatcttaagaacgtaaaggggtcctgagaccaaaagattaagaatcactgccgtcgaggttttaagcttggctaggacacagtctgtacttactgaagtaacccacagtatgacagtaataagacactttatgaagaacatattttcagtagctaagtgtcatagaaaaggaagcttgttagccatttcctcaagttgacaacagagagtccttaggaaaataattttttaaagccaatattgagccttccaagactgcacatggtgatatgttaaatttggaatttatgcaacttaaaaaactgagagtcgggggttggcatttttgtgcatcctaactgacgagtgctgccccagggctctctaacactgcacacagtctactaaagaagcaggctgcccatcatgacccccacccatcagctacacagcacacatctgcttctagatgaaccttcttgcaagtggcctgtcttatggcaaaatcaaggggcaggcctgtaaagcggaccaggaaatgagcagcaactgcataccaccaacctgttgccaagctaactgtgcttttctggatcagaggcagcttgagacactggtccctggggctgagggactgcagagcccgggcacagactccctgcctatctcccagtgtgtccatcttggtacacctggtgcatctctggattggcaagtggcactccccaattaatgttaagggccacttgttttaaatataaccagattattttaatttttaaatgtgtatcccatacttggacactgaaaggtcctccctgtttacctgcttgctggggtctgtgcttgggtgtctcattttattataaaacagagtctcaaaggcatttaatactaagatcaagtggctgggcatccatcatgtgcagagcaggagcctgatggtggtgaaggctcattctgcatgtggttgactctaggaactactttaacagaggggaagaaatacactgggagaaaggagcaggagattcgtcagggctgggggaatactggctccatgagggcagagacttttttctattttttctctttttcagagcctgtaagtgtccacatatcatgcacatgcagtgcgtatttgttgcatgagctcctggtatgcaggtgccaaatgtcatgctaagtgtgtcgactggatgacagaagaaggaaggagggattaaaggaactggtgtgcactggcctgagccttgaagaatggggtgtactgggtaaatcaaaatggtggggagcatttccagatggagaaactgcaaggaaaagcatagaagtggggccacccctcgtgagctggggagggcccagggtatgtgtgctggttggggggaagctgaaactgaggaaattcccattggatccatagcctggttctggtttccacaggcctgggatgccccgtccagagtttgactttcagtctgcacgtaatccaggctttgtattcccacttcccgtatcccctcactcctttttcacacaccctttttatctatgatgctactggggtcatgggttaagaagtcctgtcgtctaagcagcaagggtgcatcaaagcaggattttctccattgattccaaggtgtgattcagaaatggtaaaaactccgaacactaggatgagcactggggatgggttcatgttttttttttatgaaataattcagaacttattaagaattcccttggcaaaccaaattaaatattaaacaactatttgttaatatgttactattggattctatcttagaaaagtgtaattatgtgtaactgaactttttgttttcttgtggttgaaccctgaattaccatgccttctggtttccgtgtttttcctggggaataggtcatatttcttacttccaaagcccagaaataaaagcctcacacatccatccgtagtcccaaaggcttttctgcctagtacccagagagtaacagcagtgcttcaaactatttgtggacaagaagtcctaaaacatcagacacactgtggaaagcaatttcatttcattaatacaattcataattaactgcatttattttattgtctaaattccaactgctaacctatcatatcgacgaattctttgaagttgcctttattctacaggatatgttcatttttagataatgctatttttcatatactttaagttctggggtacatgtgcagaacatgcaggtttgttacatagttatatacgtgccatggtagtttgctgcacccatcaacccatcatctacattaggtatttctcctaatgctatccctcacctaccctcctaccccccgagaggccctggtgtgtgatgttcccctccttgtgtccatgtattctcttgatcatctcccacttattagtgagaacatgtggtgtttggttttctgttcctgtgttagtttgctgagaatgatggtttccagcatcatccatgtccctgcaaaggacatgaactcatccttttttatggctgcatggtattccatggtgtatatgtgccacattttctttatccagtctattgttgatgagcatttgagttggttctgggttcatgttttaaaatctcaatttgctccctagtcctaggaatgatcttctccacctccaaggaatgcaagccccagtgcaacatggattcttcctctgtaagaggctagactccaaataatttgtcctgtttttgcctgtgggatgttacaagtgtaccctgctgtctgtaattgtgtttctgaagtgttctatgtaagtaggtttttgttagttgaattgtactttaaatgtgccaatcaagttccccatgaaaagagatgggcacagagactttttgaaaaattaagcatcccaagagaaaagccgatctgaaaagactacatattatatgattccaattatatgacattctggaaaaggcaagactacagagatactgaaagatcagtgtttgccaaagattagagggagggaggggtgaacaggtggagcactgagggtttttagggcagtgaaactattccgtataatcctataatgttggatacatgtaaatatacatttgtccaaacccacagaatgtccagcaccacaaatgaacgctaatgtaaactacaggcactgggtgataatgacctgtcaatataggttcatcaactgtagcaaatgcactccgatggggaatgttgataatgtgggcaaggctacgcaagtgtaggggcagcaggtgtatggaaatcactctatcttcctctcgggtttgctgcgtactaaaattgctctgagaaataaagtctattttttaaaaaatgaagtattccaattaatttataagttttgccacacgtgcaatgacggccctaaccactttactttggttctccgatactgaatatgtcactgtgaatatctcatcctccttgatcccatccccatcaaaactagagattgaaataaggagatgagatggccctccctgaccgccttgtgcctttcagaggaggtgcctgggctggaatggggaggagctaaggactcctgtgggattctgatgctgggtgtgaaactgtctgcagttagcacggtgttggagagatgagtgctagactttgtatttctggggactagtgataaatgctcattattatttatataattttaaagctacgtttaaatttgtccccagtactagagactttaatgttatattgaaataatacataataggctgcaaatagttatattcttgtcttgttgttgtccatgtatcagcattcttgtatgaatgaaactagaaccaagaagaaaatccatcactacaataatggtccatacattaaaacagtttaggctgtctgatggtctggggtgtgtgtgtgtgtgtgtgtgtgtgtgtgtgtgatatagatatgtatgatatatatgatgtatatatgatttatatatatataaatcatctcatcttgctcaaaacaatatcactcttatttaggtaggcacactggaatatgattttaattaattgaaaagtacagtttgtttcacatttgcaggagtggtttaattcctacacagtgtactaagatggcctctcgtgggctcatgatcctggaagatatactcccaaagtgagggggggtctatgttggaagcaaaaataaaaggaatttaaagaatgacaggtctgggaaattattcttatggatggtcagttcttcatatgataaaatagttatgacaaaccaaacaggcacagtctcatgtatgcactgatttgcatgaaccaactttacagataattgattcagttggttggaactacagtttcttccaaatgtggacaacttacaacagggtgggagccccaaactgtgaagtcatgtgaggtcatatacaaactgaaaaacagggtttctctactggaatgataatcctaccatgttacacttttccccaaaatgaaatccaacatctttcacctggcgtaagaagcccaacatgttctggcccctagaaacccttacatcctgcaaagagggactagagcttgttactcttattagctactcttaaagtcacagaggtagttaatttggcaaggagtggctacaaattcaagacatgtttggatgtgctgagaatcagaatccaatctcggccctcaagtcatgggttaaagacttggttttttatctatatgaggtcctaccttgtagttcaagcagaaacatccaacaaatgaaagcagaaacaacatttgacagctcaaattcaaaagcaagaggcttgtcaatgcaaaagtcttgtgctgcaaatgtttcaagggaagtatccatactctgaagtgtgcaattgaaagaatgacctgatattcttgcactgttgcctcaaacaaacctccctcctcctagctagctccggatcttttatgcatcatatagtacatcttcccaaaaaagcaggtggaaaccaaagtgtgcaaaaacacacattttccaagaacaaatgcattatactagcaagttatgtgtggtggggctaggtgcttctgcgggtgtggaggaggaggagagaaagaagggtcaggaggaagtgtgttgggtacagagacatggaaataagaaacaggaaccctgaaagacacacccgcggaggttctgtaactgtacatgtgctcttgttaaatcgccagtttcagaggactcagatctgaggccatatagaaatctattaatttgcatcttgactttggggcttccagtaacagtaagtatttgtatttcaggatccactcagcagaaaggccatacatattcaagtcacataataaattggtgaattccaagtgaattgtgaataccaaaaaagaaaactgattatgtgactttctggaatatgatgtagaaattgacctaacaaaatgtatatgcacacttacggcatgtgtgcatgagggtgtcatttatgtacacaggtcatgtgcacatccaactcatggccatgcatgctgtagcctgttacccattctgggagatatgtaagcctttgtctttctccctccagcttcctgccttcttaaaacatttcactggtcatcaaccaatgattgaagctgggtgcagaaaaggagaaaaggtgaaaactcctcttagtccacaaggtgacgtgttagtgcttcaagtgaaagggctgtggtggagagccagagaaagcccttaggtggaatgagactgtggttcctataggtcggcaccttcctccccacccggcaggtcagctcatcaattgcacttatctcccagctgccacagcctgtctcactcctttctctctcctgttgggctgctaccaggcctggtaaactattccgtagctctgtgcaatagaaaatagatatgtatttctctgaatatagagagggaaattggagttcacatggaatgcatactgtaaacttatttgttttctgaaagcaaaaattaaacttgaaaggagcaaagcttttcaaatttcccatagtgctggcctcaaatcctaaagatttttttccttgacaagaatcatgggatgaattggaagatctggatgctccattcaccacagttgatgatgctaaaacccatgtgacagcagaggaaagaattgaacattctaaagtcccctctggcaactggaatgccaggggagccttcaccatatacctcatcaagccaccccaacaaacctgccatgtcggtgaaaagaccatgctcactatgaaaatgtggcttctgccgggtgcggtggctcacgcctgtaatcccagcactttgggaggccgaggcaggcggatcacgaggtcaggagatcgagactatcttggctaacacggtgaaaccctgtctccactaaaaatacaaaaaattagccgggcgtggtggtgggcgcctgtagtcccagctactagggaggctgaggtaggagaatagcgtgaacccgggaggcggagcttgcagtgaaccaagatcgcgccactgcactccagcctgggagacagccagactctgtctcaaaaaaaaaaaaaaaaaaagaaaaaaaaaaaagaaaatgtggcttcaagaccagaactctagccctttgtccaaaaaaaaaccatagcccccgagacccctgatggccttgacatgccactgggggtccccttatctatttacattatagaagggcttctaagaagaatggtttcagtcagagaatccaagcaacttatgctaaagtccagcctcatcctcagaactctgggcatgcttgtttttaatgccatgtctatccatctgtgactcattaacgcacttagcaaacactgagtgactgactagtctatctctccccgtgataaaatttaaacgcctcttacaagacatgagtagtctacctacctgttacttgtatgccattacctgaaaaattcccatctgtttggatgcaaacttcacagaaactctgccacaaatgctcacgaacaccatcacatgggctgggctctagtgctttggaatatcctactttcttagaaaaatcgatgagtacatataaatataattagctgcaccttgattcctgcggaatcattgtattaactgctttgggctattctccttctttcctttcaggcaatattaatttgtaacaaacacattttatgatataataaattatctttcattttttactatcaaatacatggagaagtaaaaaaacaaaaaacccagaacttctaggcagctcttaaacaagtcttgctgttacttggaaaagtaacaaattcacaggtttattgtctatgttaataaagctgtgttggagtagtcattataaccttttacattccctcctgtttacagctcacagaatatgtttacacatgtgatctcattcagttgtaacatgatctgcataaattatgggtattaacacttgccatatttattacaacgatttccccagcaatttgtcttcttaattgtataatctatattgcaaacagatgtctgcagtttgtatatgcagctatgtactcctatggtttatgcatctacctcaggccattaaactgtaagctcctggagggcagggatgtatctgattcatttctgtatctccggaacccactgcacagctgctgaatggatacacatctagttacttaacctctgtgtccttcagtttcctcatctgtgaaatggctataatgattgcaggaacctgtcttctctgtcccaattgtattaagcaaaacacttaatacaatgtctagcatataataagcactctatgagtgttttctattattattattattattattattgttataattatctggagttaattgaattaaagttcaaaaagatgacctaactcatttgggggaaggtgatgaataaacggcagaaagaaaggaatatcagggatcttatatgctgatcctagctttgtctaatctgccaagctaagtcgtaagatttttctcttttcaaaatacttctgttaagctagtaaaaattatttacttgtaaagattccatgtgctgctttttctgtcataattgcatttaccttaccaaatacatattgaccatctacacagtggatagcagaggggccacagaaatgagtaaagtctagttcactctgcactggtatctcttttcttccatatttacattttataattacatttgtcaaactgcttcacaggcgaagtcctggaccaggaaccaaataaaattgacccagctttccgaccatggaaaactaaaagtataatcaactttggcaccattaaattctgtttcatttattttttccaagagtctattaacattgtcatacagaagtagaagatttaattgagtgtgtgcattttgagttgaaagcagatactaacaagaaaagctaacctggaagacatcttgtaaactgtttcatcagactggaccaggagccaggggagggtcgaggtgactcagggctgttggcaaagctgcagaaattgccactgggtttctctgtcctctaggcaacctaggctgcattggctctctggcctattattcattacggtttagttcaccacagaggttgccagtgagcagtgcataagattagagattttgtaaaaacatgttaatttgtatgaagacgaaaattggactatggagtttagtgataaaaatagataaacagttctgtcatttgatttaaatattaaaataagacaagacaaagcttttaaggaaatgaccacttcttggttctcaactagaggcaatgcctcttctgtcctgagcagatgggtgtttgggaatacgtggggtgacttgggttgctgtgataatgcaggggttctctggcaatcagagggagagggaggggcaccttcaaactgtggtccagatctacacaatcaggaaaggctgttcacctaaaattcaaccttctgttgagaagagcaacacttacggagctcatcaaagaacgacaaaccactggaacagttcttgagaccaaagtctcattcactctgggacatatccagttacataaatcatttatgttttatcccgtctctactttcccaagaaaccctgccacacattcatagtgaatatcaaacctaattaaagatcctaagcagctgagaaaattactcaatgaccaaactataattagtcttctacaagggagaaaatgtattcaaatcattgcttaattttgtttcatttcctcttacctgcacttgaccattaagatcaaaagtctgagaatttgtggccaaaaaaaatgaacatgagtcaaagtcacatctatttgttaataatggaaagtaattccttttctaattacacgtgaaaatactagtatccaacaaacctatttgtggaaaatacggtttagattgggaaggttaattactttcaggtttttcaatgtccaaaacacacctcagaactaacaggctcagacaagatctttatgagatcactggatcctccctccaaaagcttccccctcccctgttgatctctattccatatgctgcttcatttgatcgtatagcgtgtatgatgagcctgaatgcgggcatttgttgatttgagtattacctgaaacaaaagatacaccagaatgtaaaacccaggagggcagagactgttttcccagaacctagaacaactcctggcacataccagatgtaaaatcattgtagaaagaaagaaagaaagaatgaaagaaaggaaggaaggaaggaaggcatgaaacggtgcactattattgtatgccaccttaagtcactcatagaaaatactgcatgccagcactctatgcaatgggtgttacactagccattatgtaaagtcaatgacgggattatacgctgggcactttataatttaataaacacccttcaattaccgtctcatttgctcctccatgccactccacatagtatacgggacatattttaggatcaccagtttagagataaagacagaggttgtgtccccaaagtttgcttgcgagtgtggtatttgtaacttctaaaactctaactctcccctgaaaacacgtcctaagagtggtgaggctcccacgtgaggtggcaatattggttacccccgctgagctcatcacattgcgcaggcctccacagggcagctacactctacgataaggaacatgaagccctgagagtcaggagggagaaaaaagaaaatgaacgtttggaaaagggcattcccaaatcacaggagaaggggaagaaacgtgtctcagctactaagtttctcttttccatgacgctcaaagcagaaaatggctgcacgtgggcaattcgtgcgcttggagctcagacctgcagtcttgtcgtttgtctgccctgtcttggtgcatgctgggcctgacttttttatttttccatttcaaggagccccagcagggcctggaggaaatgagttttgcagcccatctcggcccttgagcttggctcctcggctgacctcggctccccgcctgcagacccggcatgaggcaggcagcaggcactgcggggcagaacttccgggacctgcaagaccagtccgctgccttctgagacgtagttctgaggtgtagcaagttttcattttcacagcataaaaccgtctacaaatacatacttcaaaatgaaatggaggatgcgctcaaaaaaaaaaaaaaaaaaaaggcttagagacacgtcaaaagggcacaggagctcagccaggtcaaataaattcccaaatttgactcacatcacttcagcctcatctggatattacccacactctgcctaggcaggcgaagcttccgtgggatcctctgtctttagtgaattctttcctttatcttgtccagcttttcattgctctttcagaaactgagcccatggttttaaatcttaatatgaccttgcattcaattatatatatacatatatatatatatacaaagctgttttttaaagacaattttaaataagaaaaaaataattattttagataccagagagtggtgaaataataatgattcaaacttaatcctcacttcacgtaggggaaattgactcaaatctgggagcatcaaaaattaagatgcatttacaaatcctaggagaagatatcctttgtaatctcagagaaaataattgagagagggaaaattttttttgaaagacgtggtttggacatattactattttgtgaaatgaagttaaatgtatggtacagatattaaagttcacttaagttttatctatataaagtgtgtgattttggatctaaacaggcataaatatatatatgtgtgtgtgtgtgtatgtgtacatgtttgcgtacgtatgcatgtgtatgtgtacatgtttgcgtatgtatgcatgtgtatgtgtgagcgtatgtgtgtgtaagtgttgtatatgtgtgtatgtgtgtgtatatgtatgtgtgtatataataggaagtaagttggaaaacatgagccaactgacttttttttccttagacagctaaagaagagtggttagaagtttactcacaagtaaatcttttaaggagcgtttacttcccagaaacagcaatgagatcttggaggggcaattcttgtcaactgtgcatcatcaatggagtttaactgtgagaggtaaaacccattgttggtcccgactccaccaacccaaatggtcatatctgaggacttcctgtggttctcccgcccccaccctctccacggcatttactgctcctgtataccctggacttctcgacaggaaatggcaaattcctcagtaggaaagccaagaagtgggaggtcacatggagactggaagttcattgcgtgcagcccctccaggtgacaggcgacaccgcctctgcatgttgagtgcctttgtgacacatgatctccttgtctcatgaccacaggcagcagggtcctgatgagtgccctggagagaactgtcctcccacccctgggtgacacagagtctcagaagccagcagaggtgctgcaccaaaggctcagactttcaccctgcctctcttctcctcaactctttgccctaaaaaacatgtgctttgagggtgtgttgaaaatctcactaagtcaaatgatgcctgtggggcagaaataacccttgctctgaaagggtcaccaaaaagtcatgagactcctacctgtatggaaggtggtgactatatagcccttgtataaacaaacaaatacggtgaaagacttggctccatttttttttttttgtctgttcgttattttttggagaaaacgttgtgataagaagcctttagcctacaaaaatgtctctagattaatgataatttatctcacttttctcagtgaaacagatgaatcaaagaaagtgaagcatcgtagacaatataggaccttcctgataacatctaacatttaataacgtgatcacagcgtggcggctctaaaagacatgcacatgtgaattaatgcatctaacctgcacactagctaccattatgcccattttaaagatgaggaaaactgagactccaaaaattaaataagttgcctagagcatcttgccagttaatgcaccagaattctaagccagctgcctggttccaaagcgcatgcccataaacgcggaacataatgcaccaaatggcctagaactgaaacgactgcaaaaataagtcaacatatgagaaactagagaatatataaagccagccccaccataatcagtggcaagggatgggagatgggaagaagggagaagggaagggaagctaaataatttcagtttttctctgtgcctttaattcctgtcccctgaagatgacacgctcattttagtagcaacccatgaccaagatgcattccccaagcttttcgcacctgacagaaagggactcggtgtccaggactgtgcccgattacaatcaaagcagatggacccttccttagggtagggctgttcttctgacagcctcctctgtgaaactagattataagaggatgtgctgctctcagacaccctctgcctgtccccgccttggggtccttgcctttgccattcccctggtccgcatcactcctccgaggcatttgcaaaccttgttctcaccttttctttgggtctctgtctgacaggccttgcctgatcatgttctctaaactagaggtcccgccccccggccacctggctctatcatgttccctaccttccctcctaaggctcctgacttcctgccacactctgtcttcgttgagctgtgatctatttgtcagtctcccccatctgcatccccctgattgacagcactgagtgagcccagctgtcctgctgctcatgcccctcagcacccatgagcctagtgggtgcccagtaaatccttagtgagtaaatgaatgagtcaatttccacacaccaaatcccaaagggataaaaagacattgcctttctgccatttcttggaagaattttttgagacaaactaaagaaaggaagctacttgttattaaatttttaaaaatctgcctactattttcaggcaaatatgtcatgatgacatctatgaaatctctgaaattaaagagaagcctgacgtttcacaggaattaaatgaagttgctgcatcacaggtgctccctgccacagggctccgtgtggcagcagcaaacagaactcctcgctgcttaggtgtagtccttaggaatgaaaatctgaacgtagtacgttaaaaaaaaaaatcttcaaaagcaaacaaagccctaagtgtcgctgtgtattatcagggcagggtcctcctcagagagaggcgggctgcaatcgcccctacacctttcaccaagtgcctcgcttcaggggtcccattgtctccacgtttaggtttaggagcctggctcttcgtaacaccagcgaaacatgttctcctaaagatgttccctgagatacaacaccactccgcattgtttcaccacataccagcattaatatcccagagtaatccaccctcctcttaacggctgatgacggctccaatggccatgcaaaaatcagttgaaggaaagggaagtcttgtcggaaatgagattagtcttgtaacgagtgttcagccctgataacccatctgggcacagaactgcttaaactggagagcaattaaccttcacccgacaagctctgtccaaccgttataaacattaaagagacagaatccttcccccctccttgtagactaaacaaccagatttgaaattccacgtaaacggcctctttctgcagatgtgcaccaacaacaacgtttagggggaaaaggtgggcaatggctctgttcataactctggtaacttttggccttggtgtgagtgggctgaggttattagcgtaaaaattaactggaggtatttccaataaaatcaccaggtttaggggactggacatagttgctttcatgcagaaacccatgtgtcctataggaacacaacttgatgcttgagagattcttttttcttttctttctttcctttttttttttttttttttttttgagacagagtctcactctgtcgcccaggctggattgcactggtgcgctcatggctcactgcaaccttgacctccccaggctcaggtaatcctcctacctccacctcccaagtagctgggaccgcaggcgaaggccaccatgccccactaatttttctgttttttgtagagacaaggtttcaccatgttggctaggttggtctcgctcaagcgatccacccaccttggcctcccaaaatgttgggatgacaggcgtgagtcactgcgcctggacttcttttttcaacagtagaaatatttgcactgggctagactctcactcactcccaattcctctcttccgacatttgcatgagtgatgctgcttgtggtcacagaagggagattttttttttaatctccgagaagttattggttttcatggggagcaaacctgtgatcttgcctttatcagcatttgccgtaaccagtcgagttaaccaagttgggccatgtgaaataccgagtggttagagaatctaccaggaaacctactgttaaaaataactttcacaacactgaagagaaatagctgaggtcacttaatttatcactcaggcatgagctttctttagcatcagttcatgctgagccattggcttgtttatggacatgatactaacaataaataggtaaagggtaagggccctatgacatagagctggctacaaaccaatgtggggtacacaatatgcctagcatttaaacaagaaaaaaatgtaaagtacatgcagaaagtcatatgagggaaccaaacctctatgttactgacctgttaatgtgactgcaactcagatttttttaaatagaaagaaaaaaggaaaacatatatttagcatgtcctaaacaaatttatctccccaaggttttagtgcaatcttcatgatgacctgagatagctatcaaaatagtccatcctaacattcgatcttatctctcccttgaacccagtttctctttttccagtaggtaagtcataatactccaggcctcagagacgtgtttgcacacaacgaggctgagcctatctcacttataaggatgacatatctcactcatgctggactccagaccggccccaataacagttttggagagtggcatggtagaggatgtgtgttacatgggaagtactactgtaccctgggacaagatatcctggcaacaggtcttgttttcatggtttgcatttacatgcttaactgttccttttcctgcctttgtaagactaagaaaatccttactgtacagagaaggaactgtgaaaatagagcaagtgggactgactctcacattgcagggatatgcaccatctccatttttgcagccaaattagatgcaagcccaggattccactggcctggttctcccaggaacactgggagtttcttggtgtcttagcttgaggtgaggtgaagatgggctatgggcacgtgagctgaccagtttttcatcctgtgtgcattggacgtagacaagggcacacacagacatgacaagaatccatgacctagctcctaatgtaaatcttctttcccaagacaatcttgcagagccctcatggtcagtgataagaggaacttcaatttttatttggaatctgacccatttcataagaatgagtaacacctgaatatttaggtgcagatatcaaagacagaagacaaaaagaaatcatagtgtttgacaataatattagtataggatgccgttttatgagttcagtcttaggactgtgtaggtgcaacgtgaagactttcctgaagacagccacatgaatcatttttcataggatgtaatcaccactgtcatccattagtccaggcttgacacatagaatgggggtgactggctgcctaagtaacaaactccccacgtgtgcttctgacgaactgtgtgggctgccctaagcttttgcatgtctcgacacttaccaagtaaaatgatgagataaggaaaaccacaacatcatactcagtatcttgtgaaactgaaatggttgcagagtaaacactttgccttacagtgattttattttgactattatgctggatttaacaatataatggttaatatccatgctataaagttttattttttcatcaacaaaactaattgcattggcactttcaaaatgttgtttgcacataaatgatttatacttaagtatgagtgtaacaatcttgccatcaggacctggtctgttgggagatatcagtgaatggagcctggctcttccaatgggcaaccgttgtttgttggtgaagctgccacccttgagacctgcctggtctccttcccacctgtagctggctaagtagtgtctccccacaattcacgtccacctggaacctcagaatatgaccttatttagaagtaggatctttgcagatgtaattaatgattaaaatgagatcatagattagggtaggttctaaatccagtgagagcatcctcataagaggctgagcaggacacacagaaacataaagaagaaggtcgtgggatgacaaaagcagagacggaagggatgcatctacagcagtctccccttatccacgggggacacactacaagacccccaggggatgtctgaaacctcagacaggactgaacccaactgccattaactggaacactttctgttccatccacaaatgcaataccttttccatcttaactaagcacttactatccactgtggtcatcagttttgcagtttgaggtgcaacggcaaaacaagcacagatttctttttatttcttcaaacttcaaagacagaagattcattcttactgtacatcttagcaaccacagcatatgatctttttccttgtaagtacagaactttcaccttttcactgaaagaaagcactttacggcttctctttaacatacccggaattgccaggatcagtcctcttgtgccttggggctactactgaataaaagaagggctacctacacataagcactgtgataccgtgacagtcgatcccataaccaagagggctactcggtgactaacaggcaggtagcatctgtagcatggatacggtggacaaaaggggaattcatgtcctgggtggagcagggcaggatggtacaagacttcatcatgctacttagcatggtgaacaatttaagacgtatgattcatttatttctagaaatggccatctaatatcttcagacagcagatgaaactgccagaaaccatggaaagtggaatcgcggataagagaggactactgtccaagccaaggaacacagggcttgcaggcaacccccggagctggaggaggcaccagatgcatccttcctcacagcctccagaagggaccaacccagccaacacctcgattttggatttctggactcccaagctataacagaataaatttctcttgctttaagccactaggttgtaataatttgtcacagctatcctgagaaactggtaacagtacttgtggatgctgtttttaacaaaaattttgccactttagggcactatatggcctttttttttttttttttttttttgccttatagagttaggtcaatttccaaaagtgctggagtttatgccaagaattaagtgactccctggttgcagtggccaaatagcctgaaattttcaaagtaatactaattttgcaaaacttttcatgtaaactcctttgcctgaccatgccctaatttttgtgattaggaaaatctggctcttatcccactggaggaaaagtgtctagttcatattctaatggaaatcatcacttgggaggtgttttgacaaacatctctcagttttgtttaaaaattatgttagaaattaagaaaaataacgaatggaaaacaaaatctaatttttggtatattttcctgctaacatttgtgggcaaattagttaaattatgattgtttcatgcatacttactcctccaacagcatcctagctctcttaggagttccttttaattatcctaaaaacagttaagagtatactgagccaaaatataattaggttgagaaacaatgaactcctaaatgaccaatcaagttttttccaacattttaattctcaaataaaggtcatttccttttatttgactccttaaaaactagattatagttcttctaggagaggaaccaagtcagatttcttttaatcacatacattgccaaatgcatgctttactcagggaaagatttcaatatgcatcatttattcatgcattcattcattcaggaaacagagtagcactttacatgcggacgctgtggaaacaatggtgatatgaattcttaaatgattaaagaaacagtccactaaaaatcttatcaagataatagaatacttcagattttatgaaagattacattttcattggcctatatataatgttttaaccagtaaggctcactaagttaaataatatgctggataatcttaaatttacagaagggttttcagttttactatttggcttagataagctggtagttacttgctaaaattaatctttattataaagcagatcatcttgaaactgaatacaaaaacaaacgtagctattattgaaaatgttatgctatctcatatccattagagatgttatttatataataagtactgtgttgtaatttgcctgattccaatgaatacagaaaccctcagtgtgaatcaatatactagacaccagcagacatatttaaaagattgctacagtttcactgacatttcaaagaggtgactgtagtaacaaaagaagaaaaatgaatagtccctatcatagcacattaatacaacttgtcactagttcatgtccagaaagacttattatataatagattgtcaaagttgaatatttcaatgacccaatgcaaatcctggataaatgctggtaggtgttgctgctcaataaaaatgaaagtggtgtttggttttgctcatcaaggcaagtgtcatgtagcaaaatgcaggctatgggttgcctggaaactgtattcctgcttttaatttacaagtgaaacattcccatccatggcctggaagggaccatcatgtactcggcagcactcattagattctgggcagcccccggtcatctgaccttcccaaacatagggaaaggacgtggatagacattttcccaaaaagacataataatgaacaatgggtatacgacaaggtgcccaatatcactaatcatcaggaaaatgcaaatcaaagacacaatgaggtatcacctcacgcctgttcagatggctatggtcaaaaagacaagaaatagtaagtgttggcgagaatgtgagaaaagggaatccttgcagactgttggtgggaacatggaatgttgcagacactgtggaaaaaagtatggaggttcctaaagaaattaaaaatagacctaccatatgacccagcaatcccttttctgggtactttcccaaagaaatgtaatcactatctcgtaaagatacccgcagtgccatattcattgcagcattactcacaatagccaagatatgaaaggaaccaaagtgtccatcaatggatgaatacataaaataaattgtggtggatatatacaacggaatatcatttagccttttttttttttgagatggaatctcagtctgttgcccaggctggagtgcagtggcatgatctcgactgactgcaacctctgcctcccaggttcaagtgattctcctgtcttagcctcccacatagctaggattacaggcacccacgaccacaccccactaattattaaatttttagtagagacgggctttcaccatgttggccaggctggtctcgaactcctggcctcaagtgatccacctaccgtggcctcacaaagtgttgggattacaagcgtagccaccatgcccggcccatttagctttcaaaaagagattctgccaattgccacattatggatgaatctggaggacgttatgctaagtgaaataagccacacacagaaagacaaatactgcatgatctcacttatatgtaaaatctataacaaacaaacaaacaaagactcaatggggaaatggggagatgtaggtcaaagaatataaagtagcaaatatgcagggtgaacaagtctagagatctaacgtacaccataagggatatgcttaataataccgtgctgtgctgtacttgggatttttgctttaagagtagattttaggtgctcttgccccacaaaaaaagaatgtgtaaccatgtaagatgatggatatgttaatttgccttcactatcagaaccttatcaccatcttcatgtatatcaaaacatcatgttgtacaccttaaatatataaaataaaacttttaaaaaataaatcaaaaagtcatagttcaaaccactcttttggaaaagtatggatttgttaatataagtggtatataacaattgtatatgcatctggggaaaatggactccatctttcatgatataaaaagcaattctcggccaggcatggtggctcacgcctataatcccagcactttgggaggctgaggcaggtggatcacgaggtcaggagattgagaccatcctggctaacacggtgaaaccccgtctctactaaaaatacaaacaaacaaacaaacaaaaaatagccgggcatggtggcacacgtctgtagtcccagctactcgggaggctgaggcaggggaatctcttgaaccccgggagagggtggaggttgcagtgagccaagattgcaccacagcattccagcctgggcgacagagtgagactctgtctcaaaaaaataaaaaatttttaaaaaacagcaattctttgtgattttaatatagggtgccagccacatcactgattcatgcactcactcatgcatttgtcatgcaggaagttatttattcatttatgaaatggacatttactgatagcctgctttttaataggcaccatcagcatgactgaaaggttacatgacaacagccacagaacttaaggcatagaactttaacaacacacgttttgagttactggtcttgacgcctggctaattttttgtattttagtagagatggggtttcactgtgttgcccaggctggtcgtgaactcctgagctcagacaatccacccgcctcaacctcccaaagtgctgcaattacatgtgtgagccaccgcgcccggtcggggttctatagattcttaatcatgattaaccagcaatatgataattcaatagatccctgctcacctcccctaaagaatgtgccactctaagtagttggttcaaaatagcttgactttttaacctctagatccactccagagaacagtggtctctccccattgcacaaacacattcatttatttaacagcatcacccaaagcataagaatgggaggaaacaatgaacgtccttcatttctccaactttaaattatcaaaactactgattttctgggctcacaaaaatgcagttgagttcagctgttgaaagtttggttaacatgtcagttgagccaccaaatggaataacagttgtaactctcttatgttttctctactgtcctcaaaggaatagcatgagaacaaagcaattagcatacattcaggagttgcataatgatgttttggacaatgacagactgcagataggacgagggtaccataagattataatggagctgaaaaatctctatggcctagtgacatacagctgtagtaacactgtagcacaatgcatttctcacatgtttttggtggtgctggtgtacaaacctactgtgttgccagttgtataaagtatagcacatacaattctgtacagtacataatagttgataatgataatagttgactatgttattggtttacatatttactataccatacttttcatcattattttagagtgtactttttctatttccaaaaaaaaaaaaagttaattgtaaaacagcctcaggcaggtccttcaagaaggattccaaaataaggcactgttatcgtaggagatgacagctccacacagattattgtccctgcagaccttccagtggcacagggacaagatgtagagatgaaaaacagtgatattgatgatcctgaccctgtgtagacctacgctaatgtatgtgtttgtgtcttagtttttaataaaaagtttagaaagttaaaaaaaaaatagaacaaagcttattgagtaaggatataaagaatgaaaatatttctgtacaactgaaccacatatttgtgtttcaagctaagtgagtacaaaagagtcaaaaagtttaaaaaattaataagtaaaaaaagttatagtaatctaatatgaatttactattgaagaaatgttttaataaatttagtgtaaatatacagtctttttttttttttttttgagatggagtctcgctgtgtcaccagactagagtgctgtggcgcaatctcagctcactgcaacctccaactccctggttcaagggattctcctccctccgcctcccaagtagctgggattacaggcatgcgccaccatgcccggctaatttttgtatttttagtagagatggggtttcactatgttggccaggatggtctcgatctcctgacctcgtgatccgcccacctcggcctcccaaagtgctgggattacaggcatgagccaccgcgcctggccaatatacagtgtttataagtctacagtagtagatagtgatgtcctaggctttcacattcactaaccactcactgattcacccagatccacagccactttccatcctgcaagctccattcatggtaagtgccttatacaggtgtacaggtgtatcatttttttcccttcttaataataataattattattattttgagatggggtctcgctctgtagcccaggctggagtgcagaggcatgatctcagctcacagcaacctttgcctcccaggttcaagcaattctcctgcctcagcctcctgagtagctgggactacaggtgcgtgccaccatgcctggctaattttttatatttttagtagagacgggatttcactgtgttagccaggatggtctccatctcctgacctcgtgatctgcccgcctcagcctcccaaagtgctgggattacaggtgtgagccaccgcacctggcctctactgcattattactatacctttcccacattttgatacataaaaaccattgtgttaagtgtcacaattgcctacagtattcagcctggtcacatgctgcacaggtttgtagcctaggagcacaggctacacttatagcctgtagcctacgtgtgcagccggctatgccatgtacatttgtgtaagtgctctttgtgatgtttgcacgatgaaatcatctaacaactcatttctcagaactgaccgggcatggtgatgcatgactgtgtagggaaatactttcacccctttagaagaagctataaataaccaggtataaatgcaggattcctttccaaagacaaatactggaaacaaacacaatcaaggaagataattgattacttcaaaaaaacaattgagatatgagagtaaattaaataagaagactgtgactaggataagtaaccaataacagcccataacagctaacattattattattgttgttattattatgagatgaggtattttgccaggttgcccaggctgacctcagatactgaggctcaagagatcctttgctttggcttcccgagaagctgaaactacaggcagctgccagcatgcctggtctgcaatttacatcttttgtacactacagcacgttactgttcaaagcacatacaagtattaagctgcttaatccttgcaacactaccaagaagtaggagttattatcatgactgactctcttctacagatgaggaaacgaggcacagggaagtgaaaggcgtggtgggacagggacctgcggtctggatctgcttcatatagagaaactgggttcttaagaaggaaaatgggccttaatttctaaatcgtaacaagttcagccctcactcctcttttttttttttttttcactatcctggaaaaaaaaaagaagtggatagaaaggtactaataacaatgagtttaatttctcaaattttattattctttaaaaaggatacattggtacaggagtaaagacaaaaaaaatcaaaaaagaatcgagtattcaaagacccttgatggtgtaacatcaattattttaattttgtttttaaaatttttattttctaaactcctataataattgtttttcaaatggggaaaaagaacgaagtttttattactgcctttctttctacaatatattattcaatggagatactgaacctgtatttgctacaggctaaagaaaataaaataaaacaatccctagccaggcaagggagattttcagagaggatgccaacagggtcctatcccatcaggcatccatgacaaatctgtctgctgtctggtcctgtagcatcacccaaatgtggttcaggcagcactggaaacaatacagactcaggagatcagggaagtcattttgcaaagaagcagaagtgtcaggaggtagcacctgtaaggatgaatgctggagctgtctcatggagtttcacagaaaggtaacaagctgcacaatgactgtctaggggcaacagatacataggaggaaagcagtcttcattcaaacaggatactgagattgacatagtgtgtcttccaacaagataagcaaaagtatgtgaagaaatgagtccctaaaggaaaatatctctttgggcaatttcacttcaattcaatttcatgttaaatacaaaatacatatattgaatatgtggataaaatcactagaatatattcgtgcaataacatctacgtgagacatgacagcatctcaccatgtctggcagtctctcggggtcaaatgcaatctctgccccccacctggcagtcatcggcacttatggaataggccaggcagaaggctctgttagatactgccttcttcccttcgcaatgcactgtcccagacttcctggggtgagagaagtgattgtctatgagagctagcttggagtgaatgaaaacagcatttaagaggctcagcattttctgatcgccaaagggggtacccttcaacatgaggtgacccagcaatgattggctgctgagttctttgagtattttagggacctgcaggagatctgggtggagctgtgggtttccgtgtgtacagtgtgtaaacatcaccctttggtgcttcgccagtgcttaaggggctcccaggtgctatttattttgtttagtttattgttcagtgttattgtttgttgacttgatctatttttttttctcctacaaaggggccagtctgcaaggacacatcctgtagatggctaattgatgatgccctattgtttagtgtgtgtgcactgtggttttatttgcttcggttcaaagggcctaaacaatgcattcgttggaatttagtaactgctgtaaaatcagcacagagaacaatctgtgagctgatattttttgtacccaaatctggtaatctctgcttgactaaagaaagcaaaatctaaaatgacctttcaactaaccatagaaaaggccttccattgaatctcaaagagacttatttttctaccaaatataaaaacattcgaattatgcatcattttccatgattcaaaggagacagaggtgcctacggggcatgttactcatagacaagtctattctagtctaatcacgtccccttaaaaatcaccgagtagatgacaccgaggatgagaacgaggtactgtaatcattactttagaaactttatatttttacctgtttcaagacagaattctcctagaaaatctggagcaacaagcttattccccttggagaggagataacgaataatggaccacgcattcggagagaggaagtttccactgggagcccttcctgcatcagtgcgtctctggttgggctggctatctgtgtaggaagtgaacgcaggaagtatctgtctacaaaccctttatcctcaaggtaattgctgtagcagcattttactgtttaccaaagcagtaaacatgtgatctaaaaaaagatgttttccatctccagaagaacaaggctttaaaaaatgtatacatgtgcttattttgtaaccagcttatcaaaattggttacaataggcttgggctttcaacagtgagtccatgaaaacagctcttgggatggacagaggtaccctcacagggatgcacaagaaacaaagaagtggcttccttcactagaatgctatcctagcaacacacattttatgtcttttctcctaagaccggcttaaccgagttcatactgtttggcttacaaagaaggtaaagtcaacaaaactatctatgttaattcaggttggtagaatgagtaattcacaaagtccaataactcataaaagtcacttacatttggccttggacaatattcttatttttacgtgactataaatatgcttccagtttaggagttcacacaagacaaagtgaaaagttagaactcaaaaggagatgtgtagtggctgcttttgctgacttttgcctggcgtaggccaagcctcctggtccgtcttttcctttgtttctttattccagatcaagcttgcaaacctgcaccgtcccagatttcctggggtaagagaagtgattgtctaggagaggcagcttggaatgaataaaaacaggtccaggaaggatccctcagcatttaagaggctcaggaggggtccccctcatcatccttgttgtcttttgtgtttttcaagccgccttccaggtggatagcgattgcaatgagagagaaagagtatggaaggagaataagaagaatagggagacacagaagttaacaacgccctgaatgtctccttccaggacctgctgtgcagtgtccggtgaactcaccagcaagcatttcccagccctgttttaagcaatctccaatgcagatcaggtgctcgtgaataattgggagctcactgtgtctgtcagagttcttactttataatgaagagataaaaacatgttcatcacaggaaaatggacaaattggctaattgaaaacaaaattcaattcacaaactgttgtagaaattgaaaaaaaaaaggtagggggaaatgcttttcatagattccctgattttagtcttagaagaaaaatgtatttggcttgaatgaatagtaaaattaactaactttgattgaggagcttatgtgtgccatatacagttctgggctcttgcgacttggtgaatctcactataaccctgtgaagtaggaactatcactctacccatttcaccgatggaaaagcctatctcctgtgaggctgtggcttgccaaaggtgaaatggccaggaagtagaacagccagggagtgaaccccaaaagccaggtgggagcccatttcccctgcccactgcacgagacccctccccggtttgaagatccgataggggcactgctgttagctccccctgcgtcctggcagcagcacagtcagcagatggtcactgtggagaaggcggagctgaccacctccattttcctataagggagctagggccaggagaggtgcgttcacctggggaagtcctgcagcatcaaactaaagctccgggccaccctctcccagatgggcctctttccacttccccttgccagcagctatatctatgcctcccatccgttgcacggaagataaggccaatcccttttccacagaggctattttaaggatgccacgaagaaatacagagtaccaagtgcctccctgggccaaagataaaagtgggctgtgctctctggattcaaccttcatgtttttgatgctctctggaaggtcagggaaggcacacatatcgtatggatccaaagaggactacgcaatgcaaaaccacatactttttttttctttttaacttggagcaatgtcttgggacatctacctcaaattgagacacaaactaattgtgttgacagattctaaagtgttgtttcaacagtttcttcttcctcaaaggtgagcatcatgtgcacactgtcaaaattaaaaaaaaaaaaaaaaagacccaataaaacccgatgaaacccaaagagcatggagatgagaaactcactgctggctgacgatctgaatgaatggccttggggggaatgtgaatgtggaggtagcagaagggtcctgtcttcagtgcttgattctgtatcaatacttggtaaatttaaaaaacaaaaaaaccagcaagggagattttaaatcatcaaggcagaaggatttaaaaagtggaatgtgttaaatgcaagagtgcgggatctttgcataaagttattatattttcaaaaattcgacaagcattgtttttaccaaacgtgtttaaagtaacagccctgaggttaatgttatgattggattctgatgtggcactttaaaaataaatcattttgcttggccttagcatttcttttcaaaatgtctctgtacttatctgtgtacaacagcagattaccgttcttcccagagtttaattccatgaacaccctgctgaaagacttgttaaggccttatggaaaactctgacctgcgtgttcattattgacgcccaagacgagtgcaaggaagttgatacttgggatgaggaaatttaaatcagcagctgatctggaatctggaagcactgccccttggatctcgccaaatatggaaagaattcttgtcactgagcaaatatagaattcagtgctagagttttacctcttgaattttctagaactttgttttgattagccacctagagtataagaattgctgcctatgggatttttcccagaagagtagataacataaagtaaccagcgataataattttcattatccaattatttcatgtgtctccataacacttaatacatcatgtttctctgcacagtaattcactatgtacagctagggtgaatagcaggaaaaaagagatcagatgataaagagaagggagacagatttgtgtgacttgtataagatacttcgcctctctaatcctttgtccttatctgtaagaaagcagcagtacccaggctgctgtgaggatcacatgagacattatgagagtttagcacaggacttggcacataacaagcagttattaggatgatgttagtttggattatgaattcaagatactacagctacattttttatactttcttaaacatcaatttaagtcaattttaattaacgttattttactaggagaaatgtctctaaaaacataagaattctatttgaagtctacaatgataattacattactctgatatcttaacttcctctttatgatttcaaataattaaaatttaagtttatgttttcaacaagtgcttattgaacctctactctttgccagtcactgttgaggacacagaagaaatggataagatatcactaaaaacagcttctgcgatatcagtgggtatacataaattattcacactcaacaacaaacacaagcaaagctgggagaatgtgctgacaggaaagaaaatgaagagtgggagagtggacagatgggaatcgatgtgaaattttataaaacatgtcttggccaagctcagtaggggaaatatgtggaaagtaagctagaccaaacagagaataaaagtataaataagaaaaaaaatccagaggtcacagtggaccactagccaaaatgggttcacagcaaacaaacaaaaaaatgtaatgaaatactaaaattaaagaagtacaaataaaaatgagattctgttcttatctgtcagaatggcaaagattcaaagagtaaaatattcagagttgttatgggtgtagtgtggaactggtctcatatgtggctagaaaaagggagaactggtataatccttccagagaataatctggtaattattttttaaattggcaaatatttaaatttggcaaagacttaaaaaatatatatacccattggctcaataattcctttctaggcaccaatactaataaaaagtattcaaaaaattaaatagatggtgtactgcaatataatgagtgaaacatcgcaagcagcatcactttatacactaggatattggttataaaatggtaatacatattttagatagaatataatgaaacaaaaattttgcttatcaaaaaatgttagtaacatgggaaaatgcttgtaaaacaatgctaactgagaagagcaggacaggtaggtagatacaaggccaaacagatacacacggtggagagacatatcccaattgttaggaatttgctgtggttggttaggatctgaacaatttatattgactttgtgatgacttttaaacgttttctctaccataagaattttttatgtttataatttatgctaaagaacaagatgtattttttgtaattcaggagtaaagaggagagtggggtattccagggtgctgttcctgccctaaccaggagcacgatgcagtcataggcctctgccctcctccagcagcctcggctcagaacaggacgaagccaaccctctctgaccagcaccacctcgggcgacccctggacgctccacctgcccctgtgtgtggtacctgccctgctacacctttaacaagcacccctgcaagctccctcctccttccttccctgtcctgtggctgcccagacccagatgtaccctgcctgggtgtgggaggccgcacatcagagcagtctatggctgtgggcttcacagctgaagctgggccgtgggaaatgttgagacgagtgagtgcagagcctgaaagacaatacggtagaaaaggttacatccgcgggggggcgtctgatggcatctgccatttattgaggatgggtgcgagacagggtagccattatgatcccattttacaggtgacgaaactgagatcagacaggctagctaccttgcccagggtcacaacaggaaggaagcaaatgcaagtgtgtctgcggccacgtaaggtgagagaagcgctatcaggggtggtctgacagaatccccaggccagggagcagttgtcctctatcctgtggggtcaaaggaggggacaagaaggctctccttgaggtagctccaaagaaaagaccccgccagagcacagtgtgctaccaaacgctggaacagcctggagactgtccctgtctcttctctgaggtttctcatttcagagaaactctcatccgtctggcttccccatggcccttactctgtgattctcttatgtatcagctgttaaaccaataaatccgccaaattgttgggatgcctataatggctttgggtctccactcccacagagggaatcttattctaaagttctaaatgtatcagtcatattttcctgaagacaacagaaatggttgtttcatttacttatttttatgtatgctttttcaagagttgttaacctgtgtttgtgtttaaataaagatctgttttgcaaaacaaaaactttatgagataatcacttataaacgtagataattaagaaatggttcaggctcagcacattgtctgagagcattgcagtcctgcactgtatttcatgggggaagaaaagcccacagatggagccattctcaatcctgctttccagggtcactgagtcagggtgcctggcatgcatgggtgcatgcacacacaggcagagggccagggagaactgtgctgtgtccacagagggcagcctggatcacagagctgaccaagaacggaagcagcaagttgttttaaagtagttgcctgtaaagccacttttcggcaaggacaaacactcagagcatgctctgaaatgacttatgcacagcagggcagcggcattttgcccctggccttccttccattctcccggaatccccctaaagtaacaaggactgacgcaattcgtatttcacttagccaacaggttgatgaaaaatcataaatctgtagctattaaactcattaatcacatccatcaaaattctgtgaggagttaactttcttcatataactcttagtcttaattaagtttccctcacatgtgatagcaaacgttcaagaagtgcaaatgtgcagacgtggcgtatataatgcaagctttatgtctttaaattaataaaattgagtcctatcaggtcgtgtttcaattaccatcaaaccttccaacctctgttaattcaaaaaaaagtaacttctttaggcaagtcatggaaatagcactagggtgccctcaggtctccaccaagccttgttagtaactttccatgtcctgtctgatttttaagatgctttcccctgatgctgctgccggctgctggctctctccacatccttcaatgtcagatctctgtgatgatggaaaatcccccacattccctttttacacattaagtatctttctaggatcagaacttgcaacctggggttcatgttctccttaaaaggtccggggagaggactgtatttctgttgtaattctatgtatttctttttaggcaccagaaagtattattctgagaaaggactgtaggcttcactagacttcccaaattgcagatggcattaaaaaaaaaggaatcaggaaagtctttgggaaattaggctaaaactcctaactgaagcacaatcgagttttcagtgcaacagcaggatccctgcagtctgtagcaaacactgagatgtttgtggggacagtggggccggtgaggttcagcacctctcaatattgtcagatgtcaccaatgcccaagggaagcaccaaaaccaatcagtgaattgtctgcaaaccatcagctttgttgcttccaagtctttactagaactcttaagctgatcttaaaattcacagacacttagagataaatgaacactctcacataagttcccaaaattcctttacttcttccaattgaaacattttgttcccaatttcaagttaccaagggaaaatgatggtaagaatcacaaagactggatacgaatatttagcttttcatagtgtctcatagggtcttacaaatgttaatgcaaaaaaataaaaactccactcaaatgcagaaaaccaacttaaaaaattcagagcatctgatacctaatcgactaattgatttatttactgaaacaacaaaaaaacagagtgcattgagactggaaattgcctctatggggggctgtttcctaattccagtggacagccatcattttccctatgctaacttgggctttgcgctaacgtaattgaaactgtagtcaacagactcaggacctcctttttccactctataaacaaggctgtaaaatcatctcattactttacccaggaaatctaacagaaacatgtcttaaaggaagtcacctataaagagggcctattttaacagaagattaaaaaaaaattcacctgtagtcattctaagggttcacttgggtacatacaataaacacataatgcaatgtaataaaatgttaaatcaagcatagtaccttagacaagtgtaaactattatttccaaaaaagtgttcagaaaatcacaaaatattcaaactttcaaaatagcttcatgtattcataaatgtatacttcaaattaaacagtataacacatttggatgttttgcaaaatgtacctaccttctaaaggatggtctgttatttcaatgtcctttttaatgcactgagttttttgggaaaaaaaaccacataagatcgtacccaagctattcaagatttacacagaatatttgatttaacatgcatatgaataaggatgaaaataagaacaaaaaaataacattttgggtcacaaaatcaagtaatttctattcatgtagctataagtagggcacattaactctcaattttataattcctgtctataggagccatatttcagcagattccaatccttgaagccaaagaaagaaaagtataaggtgaaagttcttggtacacagatttttaatatattattgaacacaccttgagaaataaaagctgaacttctcaaacacagtttctatggtacatatgagtcaaatcttctaatacaaacatttcaaattatgaaaataccaaaccaaagagtatttttgaaaatggcttggcccaattctgggcaaacttccattttcttatgcactttccaacaaactaaaagccttatgaaaacaccaccaaatgcttctcacctccgtgcagcaaaactaaagacatgcaacaaacacaattttcttttccctccactcagcatctgcttttgttgctgatttttcacatttctacaaatgtcacgaaggcatggtggcctttaaaacaactgaacggacccccattcaagactgcatgccccttgacttgtagtcaccattaaattggcttcatttccaggaatcaggccatatttaggattgtacctgtgcagatttacctccacattaatctctacatgctatctactaaaaacttaggcaaggaaatgcatcagaccaaacaccccacagcacagagaaccgaccggccattgctttccaatctccgcaaacctaaccattgctggaagaaatcttactcacagtgcacagacagtaggtattttattgaagataaacatatagtggaacaaaccaaattacccccatttgagttacgtgagcactcagttctcagcgtggatgtcccacaaatcaagtcaacatttgcgtcccattaccagcagccacttgccgagtatctcttcgcttccactgggactgcctggcatccctgatgctaaggagccactgaagagcctccaaatgtctgacattcacaaacgcatcttttgctttgacccgacccttcaacctctccgagtctgctgccttttctcagacacacatccaggcaccgttagggatagttagagaatctgaaaattcagaagcgctccgaaaagcctttccaaaagtaatccacagcactcaacagtgaatttagaaaccccaatttttttctgagtttgaagtttttaagccttgcggatggttggagtaggaaaaaggaaatttactaggcagtgcaaaggaaatcttgttgtcctctattgtggcagtgggggtgttgcccaaccctaacttatctgccttgataaaggaaaccaaagaaaagagtaacaagaacaagattttgtcaaattaaaaggaaccctttccttaccttaatagtgctggccataatgcgatcaagtttattgatcgttaataaatgttaataataattattgcttctctctgaccagaaagtagttttgatgaggttgtttagagcggatgagattgtgctaagtctgggaaatgaagtcagccaatggcaggaagaggtttctattggtcctggctgtccagcccaaagaaacaggatatttgggagtggagagataagagaccctgaaaacaatgttgtttttcttgatgatatgcagccaggagattttttttttttaattaaaaaaagaaaaggcatcaattgggatggggactgccacagcaggtgtgaccggtgtgccgccgtgtgacacactgcactgagaccaaggcaggatgcagatgtgatgggactccgcatggcttcacacgggctgcaagcaccttggagccaaggcgttgagggcaccccactgccctgggtgtcagcccttcgcagcccaattcttcgcagaattactaggacagaggacttgagctcctttctcctaaaaggaaactttgcaggtggagtttatttcatgttaatagatggccatgttcagtaacagccattgcctggctgatttttaacaacctatatttattcaacatttcatataagtgttccagaacagtttcattttctccttccaaatacctgcactttttatttgctctacaacaaagttgttgaaaacgcaaggactctaggcttacagtaaacacaaaaaataaagaggaaaaataaaccttcctaagtcttgttttcaagtatttattaaaacccaaataactgaagtgactacaaatgtcccggaatatcagtgagctggtctcactctgacagacatccatgttgcagacaacagatcctcatagaacttttggctacccagagatgccatgtgagggccccattacatgtctaaaatccaagctataagttcagggtcacaggtctgttttctcctcgaaggaagtacagcgaatgcaggcctgaacattccttagagggtttcaggactttaattactcattttcaggaaattgcttggaagaaacattttgctttgaatctagctacaggaacgcaggacccataaagaggtgtggtctcaataggcgaccccaagaacacaatagactaaatcctgagtcatctgacaattcctggttgcagagctggacgttcagtaaatggatttcactcagactttaggccggcatgtgtcagagttctgtccaccagcccaggtcattctggcttttattatatacctctgatttatcacctcatgttaggacaaaagaaggaggagaaggagaaagataaggggggaaagggagaggaaggagaggaggaggaggagggagggaagagggcgagaaaaaatggagaaggagaaaggaaggacagaagagagagagaaaggaaggaggatgggaggaaggagggaggaaggaaggagaaagggagggagggagggaaagaaagaaggaaaagaaaagaaagagagtatattgtaagaaaatcattctgtggaaatcagaacctaagttctcagcacctacattatgagggggtgttgatttccgctcttttcatctctgaacaatgaataagatggcaggctgattaaaattctgtttccccgaaaatttcaaagtcctgagctgttttatctgggcagcttccactagaattctggagtgcggaggagaaaagctctctcagcttccctgagtgtccttgctttttgttctctcctaagaagcatcaatgtaaaatgttaactgtggcctccacaacacatggcacctgattatgcctttaccaaacaccagctttaaataagatgaacgctttgctaatgaaatagccacggaagaaaatcctgtgtggtcccgcctcacccacgcctcgtggttgctaatccagccctcagttgttccctgcagcaggaaagatcagcatttctactgggacctaatgcttcagtgatgatttggccttaactccctggttcttgcctaatgcaaatcaaactgtgaagagtgggatttcttacctctctattttgaaataatttccaacttacagaaaagccacaagataatacaccaaactcctaataccctttgcctggttaactctgattgtctactggtgccaatgtacatcattttctctgctttctctcacacatgctctctctctctcaatctctgtctctctctcccatatttatttatgtataacatacatgcatgcatatatccatcattttctaactaataaaaatattgttttataagagacaaatttatttattggatactaaaaaagagaaaaacagatgctattatttgatcaatattcgatccataagttttactgcgtctaattttggaaatgcatacaaacataaaaagtgatctaataaaaagttaatttggggatactgagtggtaaattctgttccaaaattttacaaaggaaactcctcctcatttctaatgacaaaatgtttgattgattcctgttgtcttcaaagagaataattcttgatgtttcaaatggcatcatagcatccaagcctggtaatctctgactatttaatgtaaagtgttttaaaaaaatctttggctcttgataggacaaggcacatcttttttttttttttttttttttttgggacggaatcttgctgtcgcccaggctggagtgcagtggcgcgatctcggctcactgcaagctccgcctcccagcttcacgccattctcctgcctcagcctcccgagtagctgggactgcaggcgcccgccaccacacctggctaattttttttgtatttttagtagagacggggtttcaccatattagccaggatggtctcgatctcctgacttcatgatccacccgcctcagcctcccaaagtgctgggattaaagacgtgaaccaccacgcccggccaaggcacatctattaactagaatatagcagtgcagaaaccgtttcccaaatattatcctatggggaaattatctgaagatatagatatcactctagctttcctcacttgtaccccaagtctatgttattaaatggcctcatccctacaccacccagcagcctaagaaccaggctgcctttcccacctgatacctcctctccctagggaaatatgccctccaagccaccacgcggaccaagttagggggcaatctggcacacggcccctacctgaggcccgtcctgccatgagcctatcagggcagggtcctttttcactctccttgagatgcagtaatcaccacactagaccagcacagcccatacagtagctgtggacagcagaacctatgaataaagcacacatttcccttgcatgcttctctgccacaaacccatcccctgtgaatctgccaaaaccttccactagtctcctcacattttactccaaagaaagaaacaaaataatataacataaatataccataaattcactgtcacaataaaagaaacactagtatttatttatcctaaaatcatttcttcccattttctaaagatcgaacaagttctcattcttgttcccttactaacttctctgtatggaatatggggaggaaggttaggagctaagaacactctgaatgacagccacatggttctcaatgtaatacatgcgcagagcaaagagaggagatccgtctgaacctccacatctgtggggacacaacagaagattcactcatgactcattcacgtctttatccctgccctatacatccctacaatggaacgcccttcctcctcaaaaacattgcaggaaaatgatgtcgtagatgaacacttagcaatatggaaaactgctctgatattttacctggttagttaaaaaatcacagtatataggagaattatatccatagactcattttgttaaaaataaaaaggcagttggggatggccgtgcattctgttccaaagcatctgtgaacctgaggaatagacaccatgagcgaagctaaccttcccgagttgaaaaatgaaatgcaatggtggcagacatgtccaaggaatattatggggactcgatccctttatgaatcttgtcatagatgaatgtgtggagatgtcaactagttggcagcagaacagtattggaacggtggtaatacaaggaaatagtatcatcatattagaaactttggaatgagtataaataatggctgttcaacagaaaaacccatgtcccctctccaaagggcctgtttcactatatgtaaaaattaggtcatgtatgttttcatattagactttttgttaaataaccttttttttttttttttttgagtctcactctgtcgcccaggctggagtgcagtggcgtgatctcagctcactgcaagctccgcctcctgggctcatgccattctcctgcctcagcctcctgagtagctgggactacaggtgcccgccaccaccctggctaattttttgtatttttagtagagacaggttttcaccatgttggccaggatggtctcgatctcttgaccttgtgatccactcgcctcagcctcccaaagtgctgggattacaggcgtgagccaccacgcccggccaataaccttttgtaatagtcaaaaaataaaaaataaataaaaaggcaaagtaaaaatattgacagctatatcttataataccaatggcagagaagctttttgttttttcccctcttcttctttggttcacttatattttcaaaacataaatttgtaataaacataaattatatcctaatataaaaatatgtaagtaacatgcaatgttgttcatttttgtaaatatctgaaaaatacaggcatgttctgtaaaaagtgcagcccacaatacttgtaggtgtcaaaccttttagcatgcccaaatgcctgttcttttttaaatgtctacagcaagcatagagctctttttttttttcattttattaagaaaacccagaaacgctcaagagtttcgtggaggccatctatgcggcattaatccattcaggtgatattaatggccttttcctgccaggaactccagtgggcactcaggaagccaggattacagggctctatccagtcaccgcatgtctcggcattcgggaagcctatctcagtctcctcaaattctgcacacataaaacttcagagcctgggagcgacccatgaaacgcaggtttttaaggacaaaacaataggacaaaagtgctgtatattgtccttaagatgacacatgaatttaaaatgcatagtgtttggattattcatgagagccccgcaagaacgatgtcccaggggtttttgccaggaacatgcctgagattgtagataagaatcaagcatctggggctgccgcacaatggaaaactccagcactccatggaacttttccatctgcagcagtcggaggatttgcctgagaacatacgcggcatgaagacactctcagccctcaagggcacccagtcagcgctgtttaaggacggtttttctgttcacagcatacttcatgattacagcttcactccattggatacaactatgtgagtatgtgtgtatgagtgtgtgagtgtgtgtatgagggtgtgtgtgtgggggggtaggggagtgccatatcccccagcagcacattaagaaataatccaattacaatttaaataaccattgtttcaacactttctctaagtggtgaatgtattcttcagtctcttggttgatctgaactaatagaaaccaaggaaactgttatcacataccaaatcctcaacttctcaacaccaagttgcaatttccttaatactgaagcacacgtcagttcagttctataagctcccatggagcaatgatttcaataaacacaatttcataagcatcccacacgttctcaagtttaggccaattttgctcttactcaactccatatgactttaaaaatgcaggaatattaaaaccattatcaaggactccaaataggtcaatgtattatctgtggttttaagaaagaaacctaagaggagagtaattattttgtcaccattatttagcttaaaataacttttaaatgtattgttccaattattaggcttctccatataatttggaaaccattaaatgagtttcaacttctttgtccgtataactgggtatatctgagcatagatgctacagacatcacgttgccattggtgcccataaggcttcgtatgcccacagggcatataattaagattcacaaaagcatctgactggcatcccactctacccccgactcagatccaaagtatcctttcccaggtactgtcccctgtcaccatccttggccaaattgagaatttatcccaggttgttgaaattaattttgattttgattctagtcagagttttaaatgattttttaagaagtgtgtcaatctcacctataagatactaaacagcatcacttatttttgtcttaatctgtcactattttatgaattatttttaaagaaaatacagattacttcttaaagaaagatcataagtggcactataatagcattcaattgatagaaattgatgtagaagcctgcattaataatttttcctgctgctttctaaagttggcttttagttttcggttgaggtgggctttaattcagcatcacctcatttgatgatttatttactaatttatttccatcacaaatggaatcagaaatgaagcgaaggcaaaaaatctttgccacaaattcatttatatttgcatgagtatcaccaggctacctgcggatgcaatgaagccctatacccgtgcctgaagtcaggagcacaggacactgggagtctgtctcagcgcagtaactgctacatggtacgctccacatggtatcctctccacctgagccctcctcatccctcgccccctctccacacctcaccctctccacactgtattatctcccactgcaagcaacgcagaggacacagaggtgcagctgaagtgaaggcaggccagttcttttccaattcactcttatgaaaatgtgttaaatcccgttaaatgcaccgacctgaactgaaatgatgatatcagtaaatttgttgttgtcatctgatgcccacacagatctcagcacatgttttgggaaaggctgcagtgttcaaggagtactagaaatgttctttctgagtggactggccatgataagccaaagaatattatagccgatagggataaatcatggttttcccactgcgcggttgcctggtggagattattccagcctttatttacagctacaaaaataatcctgcctcaaggattttaggaagcaaccacctcctgcctaaagaactacactgcattgttgacttgccagctagaaaccagacatgagtcgtgcagggaagttccctttgaacggcttgaattgttgtcactagagggtgctaaatgcccctcaaaaaggcctttagagagaatactagtgtgcctaattcttgatttaaattccttgaattgacattattttacaaagtggtctcattttttacttgttaaaattaagatctaacatttataatgcagaaatggtgtttttttttgaaaaatttggattgttcattattatagaacataaagaaatacacgttttaggagcaaacatgaattacacagatctgaatataagattaaaggcataaatctgggggggtgagatttgtccatggaaattgtataattgttttatgccactgttaatgattttaaagcctgaaaaatttaccactttacaataattttagattgttcaatatgttcccaaatgtgagttgcatcaaattcggtaaatgtagagtatgtttgttttctctgtacacaatactgacgtcagtgctagtgcctgcctaaactcagacaccagtagatccttttccagaactaagtgttataggaggaatatggattatactgtaatatatcagatgtgaaaaaagcctcacggtcccttcctttctcaaaaaaaacgtgtagtattttggaatatgcatggagtatagcacttctaaaaatggtactttatgtatatatgaagtaaaataggccttaaaacttaatatacagatttccttgaaaataatcttattatacatttacactgactttttggtcatccaaacattatgcacttaagcaaaaagaaatataaccaattttgcaactttcctcttcctgcctttgcttctacttaaaaatatctgcagtatttccttttctcgccgcttccactttggttcatataccaaggaatcgtgaggtcaatgggtgacagttgtttgtctgtgttcacggctgtcgggcggggctgggtgtgggtaaggctctgaccgacatctgaagaggcttcacccactgcggtttaggatacattttcctctcgctctgccagtagaacagggaggctagttttcaatgtgttctacagaaggataattaaggcagtgtgtcacctgctcgtctgctatttttaaaaggaaacaaacataacctttgcatgtgagaggcattgcaaactagatgggaggaggcccggaccctgtaacagtcgtacattccggtcccagcttcgctggggtgcaactgcagataaaagacgctggctcgacaaaaagcgcccctgggctctgcattgccagcatgcacaatacgaattgctaatgatgagctggcttaggtaggaactgaggaccctgagtgcagggctaacctctgcttcacaggaggggtccactggcgcgcgctggaggcggggagccttcgtgatatttctccgaagggaagagtccatgcagcatcctgataacagggaccttggcttcatccccaactgctcggtgaccccgatgcgtcatttaattcatttgtgccaatattcctttttcaatcaaccagtaactttgcaggtttgttcaaagaagaaattaaaatgcattggagatggaaggcagccatcttcccggagccccagtgctgacactgggaggggaaccccaggattccctcatgactgtgtcagtgatggccctcaacaagcacttactgaatgagtgaatgaatgaatgaatgaatgaatgaagccggccacagagcccaggagtatcaggggagagcaatactggctgtgtcagtggctagtccaggagagcccttcaagagcccagagttcgacttgaacttgggactcccctgggatgggtgaggttctctcaacagcagttgacaggagggaactgggacaggcccagccagtttcattcagtccagccagctgtggctcctctttaggaatgtggccaggcccagctgtggccaaagcaccagccagtccctcagttctgaacagaacgtgcccagcatcagtgccttcatttgtttttaaactgcctgctgaccatccacaaagttaagatgacagctgggacttaagttgtgaggaaccagtggctcccccatcactctctctcacacacacgcacatgcacacacacagagacacacagacacacacacatgcacacacacagagacacacaaacacacatgcacacaaagacagacacatataaacacacatatacacacatgcacacacatatatacacacagacacacaggcaaacacagacacacaatggatggtatcgatatctatgaacagatgagagagagagacagagcaggaggtcatctgctccccacccctcttctccccactgtcaccacctctctcccaagtctagctgcaggccctgtgagctgtggaagtggcttttttaagctgtcttcttagattgagtcattgggcagtgaggaaggtaaattttctctaagaagcctcccaaatctgtatcttatgggatttccgtctcaataattgagctaatagtacctgtaagcaagtggatagtcaataaaaaaaaaataccggctgtaagaacgaatgaatgaatgagtggatgagtggatgagtatacatcctctattttgctggcatcatgattattttacagcagatttatctggatttcaatataaaataagagctcccatttgtatacaacttagtccttgtaattttccaaagtaactctgattaaaattatttccagccaaactatttaggcaactgggttggtttcacacgtacttatcagaaaccattagaatggtatattgattgcatttctagacatttgccataccaccatggcaactgtatttcccaagatggcccagtaggatgtcccatcatgcataaccttctataaagtgacattgactttgcttccatcagaaagtgaggtccacgttcccactccttgaatctgagttgggctgtgactacagcagaagttcagctatgtggcttccaaggctaccttggaaaggtgatagagcttccacctgattttcttgggaacagccactcttaaacctcagccaccatacggggagaaagcccaagccatgtgacgaggccatttgtaggtgttccagtcatcagtcccagcccacagccagcattaacccccagaggtataaatgaagaaaccaagatcactccagccccaaccggcacttgactgcaaacctataagagactccaagcaaataatatctatctcagcccaatcaagccctggaaccatgagagattctaaataataaagtgatcattgtgattttaagccactgagtcctgcagtgagttgttatatagcaaccgggcatcggcataccatcagaagattccttaagaagaaacttttgcaacgttgctacagcagaaaatattccttctgtatgatcattcatccattcatcaatcttgattggcattgcctatgtgctaagcattgtcggtcactggaggtgcagaaaagaagtgaagcagtattcagccaaacaaacaacttgcatattggatagagagaaaaatatgccaaaattacaacagtattttgacccaacagaaaggacataagaagggaacatcaacagttccttcctattcttttccaccctttttctttctaggctcattaaatgtagaggtgcctcagggtcactttgccccatgagagtagataccctcctctcccatccctaactttggtcttcactctatgcctgataccagcagctccccaggctcctccatgctgttggcaccccattcccattctctggaaacatctcagcccatcaacctcagattactttcccaaggagatgtgagaaaacttcaattttcccctttgtgacttgcagagaaataggggtggtaaatgagaagcagagggagagggtggggattcattaccttgagttactaaagagaaaagctctagtgtttagaaggtgctgttattattttctctgaaacattagctcctagaaatcagaggctctgtccctagcatggtctctaaggcttccaggacgccccaggggcttccctcagtcaattttgactctaatgagagccatctggaaggctgcaatggtgggcctggctgatcactggaggggccttcgctgtgggcacagggacgtgcacaggttcacagagtgtgtctccgtttctgggaaccatggtcctgtgtgctccttccccaaagaaagcaggagaaagaaaaaccacagtcctgagtgggattctccccaaacatctaaaaagcttctttaaagaagtcaagttatcataattaaactcacatatggaatgcctatagacaacgtgttgctcttccaatcccagggagctaggacacccaaaactcacctcccagacggagctaggatttgagatactggattccacattacttaaagctgttcgagcttttcatcaggaatggaaagcattaatgcgtctcacacgtcactctctgtttcatggaattcttacactggggagctctttttattttactatttttctttaacagccagaacactgagaagtttgcaaagaaatttttcagctgcctttagtgacccttaactcaagaggttttgcctaatctgtaaattggagttgaaaatatttcagtacttttggagtggggagctttttgtctttaaaagagtggaacgacactaacaatagggctatacataccttgtgcttctttgtcagttactgcaaaccaaaaccagatgtgaagtatcagcggctacctcgtagtgacccatggaagttgaggctaatccatatcattcttaataactcaaaactgccaccttttaaccacctaatttttttctcacttacaaatgcaaaaaaaggaattgacagtacacattgaaatcgattttcccctgaccacttacagattttctcctataagagccaggaataaaagctcactccattatatcaagcagccatcatctgagtatgctttagtttaggtgatcatcacctttaacaaaccaagatctggaaggaagatttctgatctttaacaaaccaagatttgaaaactagatattcctgtcatgaccttttcccaacattcagtatgtaagggattcactggattattagactgcttgtaaatgtaagaaaacatagaaggtttagtgtgaaggagttagcaacctaacaaatgtttccccctgaattttcaataaccttcctgaatttaaaggtaatgaatataaatgaagaacaaaatcaatagatataggaatgattcacaacctcccaaatgaataaatcaatcattccaccctacatttgaacattcaatcaatattttgtctatttactaaatctaagaggaactactttaacataaaactaaatatgaaattatttccagcattgaatattgtgttttgccttagagcaggcacaaagtggaatgcctatgggtacaaagctaggcattgattgatgtttaatacctacaaatacagcaattacactgtcatgctacacgagacttcctattcctacactgaaattagactgcacatatgtagggataaaagataagacacaatcatatcatatttcctcaaatctaagactttgggtggtaagatgtaaagcacatcatgatttaaagtatcactaggaaagaaaaaacaattctgccaatgaaaattcaccgtaatactttctaatcaatcaattttaagatacatcccaatttttaagcaagaataaatgtgttaaaattaacacaaattggtacacttgtgatacaacagaagcactaaaatgtcacagcaatagaccacagggtttctcaaccttggcagcatcaacattttgggttggttaattatctgttgtgggggctgccctgtgcatggcaggatgtttgctagcattcctggcctctacccactagatgccagtaacacctcgcagactccaattatgacaaccaaaactgtctttagacatggccaactgtccctaaaggtgcaaccaaaaactgtcccagttgagaaccactggaacagagcaattcggttttatcagccttgtaatataattgtgtgtgtgcactgtgtgcatgacagactgtcagcctaatggaaggtatattgtcagatgggatagattgacctgaaaaaatcacataaaccaacagctggtacatatacaagagtgtgtcctgcccatcctaacccacacaatgcaaaagaacctggatgaccacgagtcaccatcacaggagtttactatccataagtgtaaaccatccaagaaaagtgaaaacagattaaagaaaataaaaataaataaaccaccacacaatatttgggcctagccagataacaacaatgaaaaaatgtaatattttgaagtattggcaagaatgtggaggaaaaagcattgacattcgtgtataatgggaataaaataatttatcctttgtctccgcaattgatattctagaaatctattttttagaaatactcacaatagacagttataagtacaaaggatgtctgctattacactgctcagtaacagtaaaatatgaaaatacactgtacgtctttcaatcagatattgaataattatactacacagtattaagaatgagatagatattaatgtactgcatagaaaatattcaaagtataataagttttagaaaattatcacatatgtatattagcatatgcagagaaaacatcttaaaatacaaatttcagttttgaggtttggatcatggagtaactgcccccttttcaagtcaaacagttgagaaaatttaggataaaacaagtgtgtgctacctttgtaatcagataaagtattttaaaataattcacattataatatagaaatactgaaatgccaagaaaatttaaatatattaattaaaacctacgggccaggcgcagtggctcacgcctgtaatcccagcactttgggaggccgaggcaggcggatcatgaggtcaggagattgagaccaccctgggcaacatggtgaaaccctgtctctactaaaaatacaaaaattagctgggcatggtggcgtgtgcctgtaatcccagctactcaggaggctgaggcaggagaatcgcttgaaccagggagtcggagggtgccgtgagccaagatcatgccactgcactcgagcctgacaacagagtaagactccgtctcaaaaaaaaaaataataataataggctaccaattagactttatagaatacataaatatattaatatagctacaaagaggttgaagcttattcattgagacaagagtatttattgagcatcgactttattaaatacactgttagtaagataacaagtgaaacttgttaaaaaaaaagaaactaggacaaaagaaatttgagttgagttccccaaaaacagggaatattcagattgtaggggaaattgggtaaaggatttgtttcagcatgaaaggagcaaggagcaaagaaactaaatgggaggttatgctgagaagtatatcagtatgaggaaatatcttgacatctacagacaaatatttgttgccaattcattttgggcattgaggattcacaagaataattaaaaacacgtaatataaaatccttctgattagagcacattttatggcactgcataaagagatggctgtgggagtcatttatattttaatactaacttgaacaaggcttggttctgcaaataaaacagaagagtaaatatgaagtggagcacataataatgttactgtttctgtgggtgagcttccataggaaagaggcaaaggcatcaatctcaaaaagttagaaaaacccaaagaaagaagaagaaaaataacaaatgagaacaaaattgagaaaattgtaaataatatggtagagaagataaacaaaaccaaatctggttctctgaaaagattagttatgtgtaagtcactggtgattacagagagaaaagagggaaggttaaaataaccaaagtcaacaataaaaagggggctattactacagatgctgtagacattggaaggataatagaatattatgatcaatttcctatcaataaatgtgaaaaattagttgaaatacataattggaaaatataatttaccaaaactgtcaaaagaaaaaacacaaaacctgaactcctataattattaaagacattgattgaaaaatctcagacctcttaaaggacaactccaaaaataaaaaaataaaaaaaagaaagaaagttccaggccagacggatttatcagcaaattctaacatgcatttaaaaaaaaaaggatgccactcttacataagcttttcagataaaagaaaagaaagcttgataccaaaatgtagctagaaaattatttaaaaaggaaaattatgggtcaatttcatacataaacatagatgcaaaatcctaaataaaattctagaaaacaaaacccaacagtatatacgacaataatatatattgtgaacaaactggatttattttaagaatgaaagcttgtttcaatcaaataatcaaatttacattgtaaagaaaatttatataactttaaacaaaagaagaaaagcacttaataacattcaacattcatattaaaaattcttagtaaattagaaataaagaggaagtttataaatcctacaaattgataaaaggaatctaccgaaacctacagtaaaccacacattttcatgtcaaaactttaaaatttaatcatttgaagttgggggaaaagacaaagaagccccacatattaccgcatttgtctgaaattgaattggcagtcttagttagtaaagaaggcaaggaaatgaaatgcaatgttaaaggattgggaaaaagtaaataaaactttatttacagatgacatcatttttttacacagaatttccaagagaatttggaaataagtcattagaattaataaatgagttttaaaagtttgctagatacaaggtcaatatagaattttagttttatatatcagcataaacatcaatagaaatcaaaatttttaagtgatactgttttcattagcattaaaaataccttacaatatggacataaatctaacataatacgtgcagaacctctacaccaaaaactacaaaatattattaaaagaagaccaaaataaatggatagatatattcatggattgaaaaacttaataatcaaaggtagaattttcttcaaattgatcaatagattcaatgcagatgcattcaatatttcaacaaagtttttgtgaaacttgagtgattctaaaatatgtatggaaatgcagagtcaaaaacagacaagatgctcttaaagaagagtgagaaatacaaaagattatcagagactattacaaactggaaaacctagaggaaatggatacatttctgaacacatacaacctgccaagattgaatcagaaagaaactgaaaacttaaacagaccaataacaagtaataagattggataggaaaaaaaatctcccaacaaagaaaagtcaaggaccagatggtttcactactaattctaccaaacttagaaagaagaactaataccaatcctcaccaagccatttcaaaaaattaaagaggagagaattcttcctaattcattctatgaggccaacattaccctcataacaaaatcagacaagaacacaacaaaaaagaaaactacaggctgatattcctgatgaacatcacttcagttcagcatggatacaggccaatatttctggtgaatataagttttctagtattttgttcagcaaaagctatcaacaaaatattagtagcctgaaaccaacagcacatcaaaaagataatgcaccatggtcaagtgggatgtatcccagagatgcaaggatggttcaacatacacaaatcaataaatatgatacatcacatcaatagaaaaaaacaaaaaccatatgatcatatcaataaatgcagaaaaggcatctgataaaacttaacattgtttcatagtaaaagctctcaacaaactaggtacagaagaaacatacctcaatatattaaagtccatacatgattaacccacagctaacattatactgaacggggaaaggcggaaagtctctcctctaagaactggaacaagacaaggattctcatttttatcacttctattcaatataggactggaagtcttagccagagcaatcaggcaagagaaagcaataaaggtcatccaaactggaaaagaagtcaaattgtccctctttggagatgacatgatcttacatctagaaaaacctacagactccaccaaaaaactcttaggtttaattaaaaaattcagtaaagttgcaggatacaaaaaaatcagtagcatttatatacccaataatgcactggctgagaaagaaatcaagaagaaaatcccatttacaataggtataaggaaaaaatatctaggaaaaaaattaaccaaggaagcgaaaaatctctacaaaaaaactacaaaacactaatgaaagaaatggaaaaggacacaaacaaatgaaaagacactgcatggtcatggatcagaagaactaatatcattaaaatgaccacaccacccaaataaatctacagattcaatgcaatccctgttaaaatattaacgtcatttttcacaagaatagaaaaaaacaatcctaaaatttatatgaaagcaaaaaggagcctgaatagctaaaggaaccctgaacaaaaacaacaaaactgggagcatcacataacctgacttcaaaatatattacaaggctctagtaaccaaaagagcatgatactagtataaaaacagacgcatagaccaatggaacagaattgataacccagaaataaatccacatattcacagccaaccgactttcaacaaaggcatcagtaacatacattgggaaaaagacaccctcttcaataaatggtgctggaataattggatatccatatgcgaaagaataaaactggacctctatctcttgccatatataaaaatcaactcaaggtagatgaaagacttaaacttaagaccccaaattataaaactattaaaagaaaatagagaaaacatttcaggacattgatctaagcaaagatttgatggctaagacctcaaaagcacaggcaagagaaaacagacaaatgagactatattaaactaaaacacttctgcacagcaaaggaaagaaaacaaccagcagagtgaagagacaacctgttgaatgggataaaatatttgtaaactgttcatctagtaagagaaaatccagaatatacacaaaactcaaacaactcaacaattaaaaagaaaacttttacaaagtgggcaaagaacgtcaatagacatttctcaaaagaagacacaggaatggccatcaagcatatgaaaaaaaatactcaatatcactaatcatcagggaaatgcaaatcaaaaccacaatgagatatcatcataccttagttagaatggcaattattaaaaagacaaaaaataacagatgctggccagaatgcagagaaaagggaactcttctacactgtgagtgggaatgtaaattagtacagccactatagaaaacagtagagatttctcaaaaaactaaaaataagactcaatataatccagatatctcactactgggtatttatctaatgaaaaagaaatcagtatatcaaaaagatacttgcacccacatgtttaccgcagcactatttaccatagcaaagacatgaaatcaacctaaatgtccatccacagatgaaatggtaaacaaaatgtggtacatatacacaatggaatactatttggccataaaaataaggaaatcatgtcacttgcagcaacatggatggaaccggaggtcattatgtcaagtaaaataagccaagcacaaaggacaaataccacatgttctcactcctatgtgggagctaaaaatgttaatgtcatggagatagagagtggaatgatggttaccagaggctgagcagagagtgggagtggagaggaagagagtttggataatgggtacaaacatacagttagatagaaggaataagttctgatgttgtatagcagagtagctgactatacttaacaaaaatgtattgtatagttcaaatcagctagaaaagaggacttgcaatgttcctgacacatagaaatgagaaatacccaaggtgacagacaccccaaaaccctgacttgatcattacacattctatgcatgtaacaaactatcacatgtaccccataactatgtgtgtgtgtgtatctatctatctatctatctatctatctatctatctatctatctatctatctatttatagtatccatttttaaaaggcaaatcttaaaaaaaagagtgaggtaggacaacctgctctactaaacatttttataaaggcacagcaattaggtcagaatagtgttcatgcaggtagaaacaaatcagacaatggaaaagaaaggaaagttcagaaacagattcacacatatatggacacacttgatttttgacgaaggtggcagttgatttttttttacaaaggggcagagtagttaaaaaagggagaaactgttggtaaatgatgctggaaaatgagaaatccacatgagaaacagaaacttgagaagtaactcataacatcacaaaaattgatgtcagataaactataaatctaaatatgacaagcaaaaactatgaagtttctggaacataatatagaaaactatattcctgacttgggaagggaaagattttaaaaacaaggcacagaaacactaagagtaaaggaaagactaataaattgaactgcattaaaataagaaaaaaattaggaacttaaattttcatcaaaagacactattaagagaatcaaaaggcaatgcatggagtggaagatgatatctttaacacatctaatctactattcatatccagaatatgtaaagaacccccatcaatcaataagaatacacacaagtcagaatacacacaaggaaaaacagggaagaaactgcacaggcagtcataaaagaggatatccaactgctcattaaaaggtcttctacttcattagtaaagcaggaagtacaaattaaaacctgaatgaaataacaccacagatacatcagaatgtctaaaacaaagactaacaatgttggtgaagatgtggagcaataagaactctcacacacagctggagtttaaaaaacatccttatttatccatcagggctgtaataagaggcatatagcatattcaaataggtaagtgaacaaaatttaatgaaagaatttacaacggtaaaggtagaatttagtaaaaaccaaagggtgaggaagtcccccaggctagcaagaacaggaagccattactaccctcaggcctacaagggcaagggaggtagcagtcacgcagcaccggtagctgtgaacacaggagaggataaacaataggagctgtggccttccatggagggaaaaagtcactgccaacccatgaccaaagagagaaagctggagaaaaaaactccccaagctctctcctcctactctcaggcttccttgtggtgactctcatttgcttaacccaacagaagatagaggacaaaggagcccatttgatgtagtcgacagaagtcaaactcccaggacaagaggagcagagaaggatggagaatgaattagagaagtaaacaaagaaagtcggcacatctactgtcatcaaagactgtgtaattccactatttaatacatgtacaatagagatgtgtgtatatgtgcaccagaagtcacctacaagaatgtccactgcagtattattctctcagttaaatgctatatctggctgcacaactagattaggactgagaccctaaccacacatgtagaagcagggagaaagatgcagttgagaagccctttgccatctgatatgcttccaaacaagggaaactcagcttggacactgaaagcattttgtataaaatactgtttgtatgatatccccatgtcaccacacacacacacatacagacacacacacatacacacacacacaacaaaaacaaaaaaaacttccagggttacttttctcctcagttagcaggtcaaaacttttcacgtgtgaaatacttttgcaaggaggcagatgaaacgggggagaagggataaccttgccttgcagtcatctatcaattcactgcaaggaaggaacacagagcttagatatgaagcatcaggagttcttcccaagacccttcttgtcccttgggaagagccaggagctggaggggatggccttcactgagaagtggcatcaaattagaacctgcacaacaaataggaaccagctacttaaagatccagagaagtagccctctagactgaaggatcagctcctcaaatatcctttttgattttgaactcacaagttcaggggcatccgaggaacagacacaagccagggctgaacaatctcatctgtgtccatgaggtgggcaagagccagatcctactgaggagtttgaacttaatcccaaacatggcgggaagccattggggccaaagatgaattagggattgtctgatctccttgacacgttctgaaggttttgtgtacagaaaaggtttgtcaacatgcacaaaggaaagctgggataaccaagctaagacgctaccgcatcattctaggggacgggtgactcattccaggagtttctgcaggaagacctatcaggactggtgattgactggaggcagagagcacgaaaaaagaacaatcagagatgatctgtggtttgtggttgttgtgtaatgttaaggcttaacaactgcgaaaatagtgtttttactttacagagaagaagacttgaagaatacaagattggggagagcagatcgggatttgtactttatatcagacgtgctcatagatatacatgttgagatatcagttgggagctggatatatcaggattcgagactgggaatcaccagtttatagatggtttttaagccatgtgattggatctcatttcttagtggggagaagtgagataacaaataaaagccaagattaaagctgaaccttcagcctgcccatcacttagaagcccagcagggacagaagagccagccgacagcacagagtcgaggaggaggatttccgggcttcagtgagtgtgcatcagagattcatggacacaacttaaagtaagaccagccacacagttcccttcattttctcaagcaacattcagcatctcaaagtgcggctactacacacggagccaagccctggtccagttatcacaaaaccttactagatatgtcgattattagctgcattttatagctaaaggtaggcaggcacagagaagttacgtctcttgcccacagtcacagcaagcaaacagacctcagaccaaagtctttctaactccttatttcacatctaaaacactatgtgacgccacctccaaaaaatgtgggggttactctaggacaaaagaagctcatgaaagcaaagagagaagcatagagcttaaatttagaacaatattcagggtgattgggaaaaatagcctccatacaaatataatcggttcatcaccaggtgaataaaatgagagaggaacctggtacaagtgaagttcattgaatttgcttgcaaaaaaacataattcaagtgtggaagtttggaaactaaaatagtaatcagctaaagaaattttcaggccaacttagacacaatggtgacaaagctcccctgaggagacaggaactatactacttgcaactctaactgaatggacttaacttagcaattaagatcaccgtaagtttgatcagataagtattaaagggtgtcttgggtacatttgcagattcagacactcttagttgtgaaattcttcaccaaaaatttgcaacttatggcttgcacattaaaaacatgatatgaatgaaattcagatatctcttggtaaattttataattattcctcccatcagctaaagttctcagtatgaagggttataactgatgtcatatacaataactacaagctgtatcatacaaaaattgagaattttctattatagaaagagttgctttaatctaaacctaaagtagcatcaataatttttcgtaagtggtccccttcctatgagtaagcccccaggaaaaataaattgcttttaagaaatgctgtaagtaagctgtttcatatataagttttgacaagatctggctacttaaattacaagatataaaatgagatttgtactttttctcaaatgtaaaaaaaaagatttacttctgaaataatggtctttataaaatatgcatttttgttcctttttcttatcatatctataaatttactaataaaagattctatcttgatttactaacatttgaaaagattgattatattggtattgcaagaagaggataccataaattaaaaatccatatattaaccatattcttttatttgcaatatgacaaatgattgtgtaaagttataatcaataaaagctatttgaaagtcataaaatggatattgccataactgctttcctagcaaggttaaaacactttaactatttttaatcaacttacagtgtagtagatcaagcatatctaaatattttattttaatcaagcaaatatatttctgctgttcctatgacagtatgaaagtttggttcaaaatatttccaaggtatttaacacagttcagtagaggtcctgtctcataaatcaatttcagattagataaaaggaaaaagcaaattcttgtttacttcagaatttttcaagccagttccaaagacagagttgttactctcatgtgaattttcagtagaaagctgaacaacgacgttgctctgacaatctttttaaataccatatgatggagacagaataacaaaaacaaagtaggtataagctgtacgaaattatttctcttggacataaaatatgtttggggaagaaatgcattgttccatatggactagggtagttacttctcaaagtgggagcaactcagactctgaaaaatggtttctcaaaggaggcattgtgtctgggtgaggccagttttctagtcaaaatcattttattaaatgccattggattgaatgcttccaggtttgctctctgaaatatgccctatcattcttaaaaaacacacttaggtagcaaaaagggcacactaaaaataacgtgggttaatgtttctatcctgcctgtgttttctaagtagcccctgcctgagctttcgacttttttaaatgaaccatcaaatagttggttgtctatcacaaataagccatctattttgttattcctgtaactttttgtagaatccagaaagtaacattcttgctgatatatcttatataacaccaagtccattttccaaatgaggattccaatgagtattcatcaccaacatctccccgaaaaatatttagaaaaaacagactcaatcctttatccaaagtcagtgagtaagaggcgggggccagggttggacaaaaatctctttggccaggaagccggtggtcaccctgatctacttctctaagctcccacccctgatgaatgttcaatatctgagtttcaccccactcattattgtaattctccgtaaaaccccagttacccacacggaattctcatctacatctagcccaatttgctactggatttcaatgttatttcatatgaaaacaatcactaacagaaagaacctggatctggtttcgaaaacataatttgaaaggaattcattctgaaggctgcaaaagcccagtgatggcccatcggtaccctgaatgggcttctcaggtgcctccactctcctccgtatgtctccatccatctcagaatacatgtctggctcttcctgctcataaacagaaacagagagttccgggatccaaaggcaagactgcgatttaagagacactttgtttttgtaggtgttcaaggatttggaatcaaagcagcagaattattaaaattaatccaattttcttgcatttattttgttagttcatacctctaaaagatatattttggaaggcacccttcaacccacccatttacaaatcaaagctttctttggaatccctgagaccaaacccaagctagacagtgacacactgccagctccagagccctgcccacctggaaggggtatggaatgcactatttgacttgagctcacatttaattacagtgtcaaaaatcaaacttaaattgctttaatcagctgccaacactatgagcctttctggcttgaatttctataaacaaagaataaattcaaatctgtcacaaagtggcagcaacttgttgaccactggactaggaatcgttatgcaaccatggctcactgtggaaaaagtcaacatcttcctatatgtgactcttttctgatcttttcggactattagtcaacagaatcatcataaagctaaattatctatctgcactgaaattactcagcctcagacatccaaaccagtagctgttcaccaatgaaacctgaataaagctgttgctgactttccctgcttcaatttagagtatttttggaaacatcattgcatgtttaaaatataataagcaaaaggacctttggtaattaaacattctgtaatttaaaactccaagagacaggagcagtgataagatattagattttctttactggggtgaaaaagacagaaagtggttaactgtttaaaaaaagaaagaaagaaagaaatccaaggatttttagagccagaaacagtaacagtgtcctttattctggaaatgtttaaaagcctgtaagcagagatcacccagttcatcctgagcattggtgagcaaataacttctgaaatgctcttgaaagagaattctccagccttctctgtttgaaatacttcctaaagcaaacacaaaagtgggcaaaacacaagagctcatgttaattccaaacaaagagaccaacagtcgcaaattgagagtccatcttagaagcgggtgctgcttccacatcaagcaactattggaaagagtaggggtagatgcagaattaagatcatttgtgactacagaaagagacaagaaaattaatttttaaaactaaaagagaaatttatttcagataatccaaggaaatgagcagagtcaacctaacaggattctcaagcccctccctactggtgtggtgtgaagatcacacgtggtgtagctgacacccctcacatcttccccgcgcccctcctgccacctctttttggcattcaccctctctcgggttctgtatccctgcccatgttctccatgaaaggccatgttaatgcccatgctctttcctgcctctaacagacgatgccttccacagtcactcaagctttaaccctcttctggattcggacctgtacatccaaaagcctgccagacatctcttccagatgctctcagagcacatgaccagaagcacgcgcaaagctctcctgagcctcagtgctttccctccaacacttcttccactctctcagttaccgagccaagacacagagttgcttgtgagtcatttctctacctcatcccccacccaaccttcctgcgagatcctgctcacgttacctcctaaatgctgttacgtgacttcaaccacgtcagctttttatgggggaggagaggcacctgcatatctgtgggagcaccaacctctagacatctcctgccaagttactgcaatgtgcagaaaagaggaagaaagcaagcccaagtcgcaaagtctttgccagtccttctaccaaccacaccttcggtggagatgtgggtctgtggaaatgcagagacggactgaaagccaaatgggccaatgagagctctgaacaaaacattaagcttgtttttctttaaggcaatacgattaacagtggtccattaagaatccgtttaaaaaaaataataataatactttttctgactattgttggggaagaataactcctttatggggagtatgaactcaaagacatgatattgtaaaggaggccttgaagaagagagggactaagaaatgtgatggcgtggtctgttacatgtgcaggtgctgtgtgtgagggaagcactgaggaccactggaggatgagggatgctctgtccttctcgggtatggctgaaggacagggattgcccatcaaggagtaaataatccatgagtggactaaattctttagaaacaggaactcaaatccagtagggattaggataaaaatgtaaactctaatttgcacctctccctctctcccctaagtagtccgtttctataattttatactaaatcaattaaatgtatctgctataatattaatcataattttgtctgaagtagtaacaactggaaactacctaaaagagtcagagcaggactgtaagactatattgtagtctacactatgtcacagcggactgcatcatgatagagaacgatactcatgatttaactgataaacacatatggcaatgaataaaactgtgagtaagatgtctttaattttagcaaaattatcttcattctaattttcaagtaaacttaaagatttatatataaatgcacataatttaattaaaatacatgcatatattaactagaaggctaatcccccaaaatgtccatagatgttatttctgagtgaggagggtcaggaaggttttaattttctttgtactaactctatttactaaaatgtccacctggattaacgttataataaaaatgttaccgtttaaaataaaatgaataaaatacaccggtatgaaggtattattagaacatacgaaagtacaaaatcaagcagcaaaaggaggaaattatattaagaactgaaaaaactatgttgagaattctgtctaagaaacgctgtagcaattaagaaaaatcccagttctgcaagtaatgggagaaagatgatgacttccagaactttcaccatctactaagatgttcaccaattcctaagaagggactgaatacgtctgcatcctcagatctgagagtaattttccacgacgcatactgagcaccataatgagtgaagtctctgagatgacctctctgacctctctaaaacaatcaggcactgcaaacatggcctatcccacactagcccttggtgaaattcaagggcataatattagactgaaacagtgagaagaagattcgacatggagtgcggcaagaatgtgttctagtccttgaaggccagcgctattccaagtgtggtctcagaccagcagcctcagctgcagctgggggcttggaaatggaaacgtatgtgctacgtcctggacctgtggaatcagaatctctgaggtggaccaggaatctgtgtttttaaaaccctgtggttggtaacttcctgctggctgaggacagagagaatgcttagtgaacgctgaggaatgacgggttaaataatccctgaatgattcctgagcggatcaatttctcagccagagttttgaccgcagctgatgatgaacagggctgtgaccaccaggaagggtctgaagaggaggcgttgattgcagttttctgcctctgatcctcaggcatggagccccaccccccaactctcttacacggaggccaaagaaaaagctggaattctccaggagagcaggacctgttaaacagcaaagggcaacccaaaattgtatgagtggccttgccctgagaagctttgaagccagaggttactgaacaactaccctggttaaaaccctaacgtgacaatgataacatgtgactgtatgtggctgtcttcaaaacagcaatgatttaggcacaactgtggatctcagattgttccgtgagtttggtctgataagattgtatgcgtttcccaggggtgccataacaaagtgccacaccctgggcggcttccgccaccgaaatgtattttctcacagctctgaggtcgaaagtccaagatcaaggtgtcagcagggctggttccttttgaggctgtgagggaggatctgttctaggctctctctcccccagcttctgggggctgctgcagtctttggtgttccttggcttatagaagcatcatcccaatctctgcttttgcgttcacatggccttctcctcatatacctgtctgtctccaaatttcctcttctcataaggacaccaagcactggattaggggcccaccctactacatctgcaataaccctatttccaaataaggtcacattttgagggaccagctaaatacaaaacattagccaggcatggtggtgggcacctgtagttccagctactcaggagaatcacttgaacctggattagaacttcacaattactgacacgattcaacccatattaggttgtttagtattatacattaggaagccatagcaaacttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcccatagcaaacttttgtaaacataactatttattaaaatttggtataattaatatttaaatatcctttctggcaagatttagccagttttttaagcttcattgagagaaccacaatattagcattaataatagaatggtctattaattttttaaaaagatactatgtctgcatttccaatataaaattcacagcaatgattcaggtagaaattaaatgaggatgtcattgtcaaccttttaaattatattacaggagcagggagcacacgggccctgaggtagaaatgaataaggaatattctagaaccaccaagaagccagtgtggccacagcagagtgagccagtggtgctggaggcaggtgagatcttgaagggccttggcaacatgaacaggagcttggattttatccacattgccgagggaagtatgaggtggtgtttagcagggcataaatctcatctgatctgtactttgaggaaaacactctgacttctgtgtggagaacagtctataggaagccaagaggagaggcagggagatgagggaggggtgacttcagtctccaggagaatgagctagtgatgtgaattaaggtgctggtggtggaggaagtgaggtggagaactggacactgggatctattttgaagagggagcctacagaacttgttggtggatggctatgagggaaagaggattaaagaatgatgctaggcatttgggcttaaacaaacccctgagtaaatggttatcctattattaatactaagatgggtaatgctagggaaggagtagccttggggagcagtgatgagttattttcttagagagaagccacgttacctataggaggctcaacagagtatcaaattagaataaaatatctaatgttctgatttgtgtctttattttttccattaagatacacatggctggccaggcgcggtggctcatgcctgtaatcccagcactttgggaggctgaggcaggccgatcacctgaggtcaggagtttgagaccagcctggccaacgtggtgttaccccgtctgtattaaaaatacaaaatattagccaggcatggtggtgggcacctgtagttccagctactcaggaggctgaggtaggagaatcacttgaacccaggaggcagaagttgcagtgaaccgagatcacgccattgcactccagcctgggtgacaagagcgaaactccgtctcaaaaataaaaataaacaaaaaccatgggaaagaacaattgaggaaactggggacttgtcctggaacagaagacacgaggacttttggttttttagttttgtttttgtttttgagacagagtcttgctctgttgcctgagctggagtgcaatggtgcgaactcagctcactgcaacctccgcctcctgtattcaagtgattctcccacctttgcctcctgagtagctgagactataggcgcacaccaccatgcccagctaatttttgcatttttagtagagagagggtttcatcgtgttggccaggctgtcctcaaactcctgacctcaagtgatccacccgcctcggcctcccaaagtgccgggattgcagaagtgagccactgcgtccagcaagaatgaggtttgaagggaggcatgattgtgttctcttcaaatagttgaaaggttccatttgaaaaagggatttacttattcctatggttctagtaagttgcagagggtggatctaagaccattgggtgaactttacagagaggccagaaagccttctccaggggaagaaagtcaagaaaaggtctcaaaactgtctggcagaattctgcacaggagagtcctcaattcggtgtagaattggcaagtataataactgtaaatccctctcaatctaccatctacatcattaggcgacatcttcatttcctgaaaattccaacacatgaaggctcacttactatcaagatgagcaagtttgtgctacatagtgaatttgatttcaataggactcattttataccttttaagagtctttaaaacgttgaaaatgtaaagatctgcaagagcaactgatcttcaaagtcccgtcgagtcacaggattttgtaatgatgtctaaagaggaaaattcccatttcagaaaaggctcaatagtatttaatagttagctcaaaaggacgaataaagttctacatgggaagctgctgaactacagtcaggccaaaccttcatactcggagaagatgactgggcctgtagacacagatattgatgataaatcatcacaaaccacagctttccttaattggggtggtgggcagggagagcaggcttcaggttggccttcctccagcaagggcacacacacaaaggggacctgaacacgtggagcttatggtcaggaagcctgaagtgcctgacccagcacatctggtgactagtagtgtagattccccacagaaggaatgacaaggcgtcattattcaaagtgaccttccctccattggaataatcagaaacagctcacaaataaagtaatctgtaagatgcttcatcttctctaggtaacctctccccaacatgatgacatcacttcacatgaggcgacatggttttgtgaggacttttctttccttccaagtttggaatctggctgaaggctaaaatcaccatttacagtgtttgagccctccttcacactttgaagaagggtctgtgtaaatagccattcctacttctcagactcgccagaggcaaaacctgttttgctttggtagtacacgctcttccttaactggtaaaagactttaaaaaaaaataagatgccatttttaattgtttcataaatctggcttagatatattaaggaaattgctattttatatgtagaacagcggcaagcaaatctcaagagattaaaaatcatgttcttgtggttttcttttagaagctgcaaatttgaattcaatttaaaaaatcatggcacagggacaaaataagaatgaacaaagatgggaaaaatgtccgcagcattctgcagagtcaagcgctgctgtgagtgagtgtgcatgtttccaattacacatcagggcttggcgagctccaggagtcaaattcagacagaacccaagtgcagtgcgttacacagaacccaggccaggaaaagcttcacagagtctttctttcaactgaggcaattgtgtagacaatttggttcatttcaagaaaaaaataaaactgacagaagaaagaaaaatattattatattttgcctctcaaaacaaagtcaaattgtgttggtgtataaatcaagattcagtatttccttggctgcttccagaataatagtagatcacaaagagaataagaacaagaaagttcagttctcagccagacgatccaaggtaacaaagggtgagaccctcattccgttactcacaggagcaaacagacaaccaataataattgggcacatgggggtttcaacaagataaactgttatgtgagtccagggtgctaatttctggattcttttgagttgcaaggaaaatatataccgattccccacccccacccacccacataacaagacacaatagttaacagctggaagactgtggttagggggaaatgtgattgtaggcttccatttcaaatgatggaaaatcatttctgaagtcactacgaaagttacttcacaaaactaaaagaagccttgacaccttgtgttatcccatcatctaaagcaattctagtttggaaacacttgattcttggcaggggattctaaagaaggtgccgtatgtgaaaggctggtgtgtcagaaggagctttaaggaactggaatgagaacagccaaaagctaagatttctgattataatcacaggtctggatgtgttcaaggtaaaaagagatcatccccatcatttgcaatattttcaagagaatggggctttagtgacactgatcaaagtctgacatggattttcagctgccttccaactccacatacctgcaattcaatgatctctatggatagtagaagtaactgccaccctgatgttctcatcggtgatttatacgtgaagtggactcaaaagaaatacaacgaaatcccttaataaaaattatgtccattgacccaacaagcttcccagtgctgtatcagttctcaaccgattttagagacatttggtcaaaaatgatctacttgtaataagccatctgagggcactagctctttttcacctctgtgttccttgaagcaggaagtcagtaaaatcactattgaattaaaatgaagtaaagcactttgagatttcagatttctaaattaaggaacacacaacatacggtactttatttgcacaagaattattagaacccagggctaacacccaaatgaggtcacaggtaaatgaaaatctgtctcagttatttgaactcaggtcaacacacagacagagcaaagcaccagctgacctctgatgcacaacccagtgttcttaccatagaattccagaaggcatctcagtcattctcttatgtaaatacaaagacgacaactggtttaaaaattcatttatttttattttagcttctttgtgtcaaactcaaagaagcctcacataaatgatcaaagactttttggtggatcttccaaacgtacatgccgggaaggcctgcttgcactttttccttcaatcctctaaaatgaaggttttgaagatgcttgccaatggaacgttgtgccttacagctataatattttttaaaaggcattcagtttaaattaatatatttggccagacaactgtattaaaattcttgttgttttttctgttataatggtagcctgtggtatgactagtcttcttcaaaaatatgtacagttattgcttctctcttgcctggggtatatcatgtgtttttcatttgagtgtacattgcaatacctcattaaaaccaacacttaggctacacaaaagtcttcatatcatgccgcaaagggcgtaaactaacgtggaaagtttcagagcctcataactcattgcatatacctcttatactagctgctcaactgatatttagctctcctggatgatgtcacagtttttatcctcttaaaatagcctgccttcagaaaatatatagtttccttcatgcactaatcatggggagttacgatgtaaatagagccattttttttcttatacaaggaacaagtgctctcaccctcctcccttctctccctccccatacacagaagcacacttcacttcacttatactaaacacttcacttatacttacactgcaacaaagagttgcaaatacatgcaaataaagcctttataactcccctctctcctgctggacagctccttgactcaagtatttccgaagacagacactctgataagggtctgctctgagcttcattctcagcatacagtcctgggattatttacctaccaatattcacctctgcatgaaccagtaagtcattactgacaagaaaaaaacaatttgtgattttttttaatgtcacaatttttctttttaaggtttgggagagaaagttgttttgaatgtttcatcagtttctattgccaaatgaacacctgtttcagagtccctgaaagtcacacatcagaagcttctgacttcaacatatagtctgctttgaagaattattttaaaaaagcattgactgcttgaagataagcaagtgacactcaatagcttcattctttagtcttagaaaataatttttacacttcacacctattaggatggctactatgaaatataaaaaaaattaaaaataacaatggtggcaaaaatatgaagaaattagaacccttgtgcactgctggtgggaatatcaaatgatacagcctctatggaaaacagtatggtggctcctcaaaaaattaaaaatagaattaccatatgatccagcaattctacttctgggtatatattcaaaaaaatttaaagcaggatctcaaagagttctttgtacagccatgttcatggcagcattactcacaatagccaaaaggtcaaagcaacccaatcgtccatccacagatgaatgaataaacaaaatgtggcatacaataaaatgtcattcagtctttaaaaagaagaaaatttggacacattgtacaatatagatgaatctttttttaaattaaagtggtttttttaatcgttttattttaaagttccgagggacatgtgcaggatgtgcaggtgtgttacataggtaaacgtgtgccatggtggtttgctgcacctatcaacccatcacctaggtattaagcccagtatgtattagctattttccctaaggctctcccacccccaccatcccccaacatacaccatagatgaatcttaaggacattatgctgcgtgaaataaaccagtcacaaaaagacaaacagtgtatgattctacttatgtgaggtacctagagtagtccaagttcagaaagtagtaataatggttgccaaaaggtgggagcatgcagaacacggggagtgttgattgacatcaagtttctgttttgcaaggtaaagaagttccagagatttgctgcaccaacaatgtgaatatacttaacactactgaactgtaaagtggttgtgactacagattttatgttttatgtgtttgccacaaccaaaaataaagattaaattaaaaaataaaagattttatagcacctatcacttaccaaacccactgtacatcttacactcgtgaatattttatgattttcaaaacacctttatttttttcccttatttgttcattccttcatgtataacccacaatgtgttaggttatgtgctgggcagcctggaagacccaaagacgaattagggaagtaccctatatttaaagccttgcaaggacataaatatcagtaatataaagtaaaatatgttcactgctgaaaactgctatacttcctagatttttcaattcaattgcaatttctaatattttgccatgttgatcccacaaattcacttgtgtttaaaagttaacgtgcttgattatcatacagctgcttctttcataagaggaatacagataaaacgctatgggatttcagggggagaaagaacttcttattaaattcatattttcaaccaataagaaaacacaattttttttaatcaacactatcttcttggtgcttttttcacatctcatcctctttcctcctttaccctgcctaagcaaccatttctggacccaatcttgggttattacatctgacggcaagtgttatgtgggccatggaccatgagcaattagccccctctctactcctagggatggagtacatgtgatgatttccatcagactcagattaaatatcttgctggtaagttacccctaaaaatcgattaatggactctccaggtagacactgaggtaatctccaaccaaacctgacttatacttaggggctttggaagcccaccagagtcatcaagccatatctccacctaggctctatactggaaagctggtcagtagtaacacaaagaacaagccatttgggaaaacagcccacatgaaaagaactgtggtttcaagaagagtcattccatcccaggtttaaaatactcttctcctctttatctaccttgaggactcctatctatccttccataccagatccagcctcatcttctaagtgaagccctcctctgggacgtcagcgtctcctctgcatcccctagcattttatgcatcctctgttaaagcaactgtttgcacagctgtatccaccactaaacttagaggcaacagaccatggttttgaatgtgtagaacccaacacagagcccgagacctagtgggtattcagtgcatgttgaagggaagaatgaatgcatgagcaaacaagacaatggaagtctgtcatcagtatttacatttcaaaatgcaaagtgaaaattgtgcaaatctctaatcaagctgtactttaaaatgctaaattgatttggctaaaaatatttcaacactgaaatttctttttgcaagttaagtcttcgcataaccaaaacagaaaagaacgtatcaatgaactaaatagataaatttatggctgacaaaatctcaagatttagtgtgtgagaggaaagtaaaattcaatgtgtccttgaaagttctggggtctaagatatacaggccaatggaatagaatagagacttcagaaataaactattgcatatatggtctgataacttttgaaagtggttcaaagatcatttaatgagaaaaaaaggagtcttttcaacaactggtgttgggaaaactgggtatacatatgcaaaagaaaaaagttgggctcttaccttatactatatacaaaaattaactcaaaatagaacaaagaccaaaaaataaaagctaaaactctaaaattcttatgagaaaactctaaaatgcttagggaataacttcataacactggatttcacaagcctgtcttgaatatgacaccaaaagcacaggcaacataaataaaagagacaaatttgcctgcactaaaattaaacacttttgtgagtcaaacaagctatcaacaaagtcaaaagacatcctataaaataagagaaaatatctgaaaataatttatctaataagggattaatatccagaaaaaaaaatatatatatatatgtatataacctacaactcaacaacaacaacaaaaacaacccaatttaaaaatgggcaaaggacttgaacagaattttttccaaagataacactaatggccaataagtacatgaaattatgctcaacatcactaatcattgggaaaatgcaactcaaatccacaatgaaatacttcgtagccattagtatgactattaccaaaaaatcagaaaattacaagtgctggtggagatatggaaaagttgcaaatcttatgcactggtggtgggagagtaaaatgggaaagtcactataaaaaacagtctagtgattcaaaaattaaaaatagaattaacatatgattcaccaattccgcatgaagatagcaggaaattgaactgatatttgcacatccatgttcatagcagcattatttacaataaccaaaaggtggaggcaacccaagtgtccatccacagatgagtggataaacaaaatgtgatatacacatatcatgggatatcttcagccttagaaaaggagagaaattctgacatatgctataacacagatggacctttggaaagttaagagattgtcttatttatcttacgctaagagaaataagccatccacaaaaggacaaatgctgtacgattccacttgtgtgagttacctagggcagtcaaattcacagaaacagaaagtaaaatgatggtttccaggggctgagagaagggtagaatggaaagctattgtttaatgggttggagtgtcagtgtaagaaaatgaaaaaagttctggagatggatgatggtgagttttgcaccacaatgtgaatgtatttaataccactcaactgtacactaaaaaatggttaggatgataaattttatgtatattttactataacaaaaagtcataaaaatcaaacatggttcttctcattaaaaaaaaaagaagattcctgggtctagttggttctccctccttcttagttcttggatcaaggagatagaattgtgtccaaagtgaccaagtgacctacggagtaatgggcttccatctagccactccctgctttatgactgagctgcactgggagaggcattgtcaggggaaattccaggtttctagaattggtatctagccagaatttgtcccagggctaagtggctaaggcagtgaactagtctgtcagcttctctgttttaaatggagtcatgtaattccattacataccctttgctttcaactatatggccaaacatgactggccagcaggctgggggacagaagacatgtgggcttgtgcttgttacctggaattgaaaagagctcttggcatggttcttgttcaagctccatggttgactagcacatgaccaccaagagagctactgtacttctccgagactcattttctcttctgtaaaaaatgactgagtttctttcacagtgcataaatcttttcctccaggaacagagactgcccagggcctgtccaagacaactaggaaaccagagcagcagttaagccattcctgggcaggaataaatgagcagatgtcagctctcagaatctcagttttctcactcataaaatggaaaagaatactatttcttttatgtcattcaccatattgtgagctgaaggcactttaacgatgctgaggctgtaaactaatgcataatgtgatgtttatcattcttcacctatgttttagttactgagcatctcctgacaccagagaggacgcaacaaaaatcacaactcctagaactgcacagtctaaatggcaaccactagcccctgtgacaactgatcacttgaaaagtgagtagtccaaattaagatgtgctgtaggtgcaaaatatatgctggatttggaagatgttctatgaaaaaagtatctcattagtcatttttatattgattacatattaaaaagattccattttggctatgctggactcttcagatatatcctgggagattgtattaaaagaaaatacatgatggaaattagtgtaggtagttactagaaaatgtaaaattacatgattcacatcctatgttcactgttctagacatataaatataactttgagttatttttaagcatgagaagacagaaatcgacgaataaagtgaaaaagctaaagattaaagatacttacaaatcattgttgtattttttaagaggtcattttgagcatattccttaccattgaagcccctgcctgtctggctcctctgcccaccttgttttgctaatgggtcatgctcctatatgtgcatagacgaggagcggctctcagggactgaccgtaagcatagtcagcacagcacgtatacccatgctctgaccccaggttggcgtcttggagggtgaagcattttcccagtccttctttgactcatcacagaggtataaaacagcgtctccaacacgtgatttttttttttttttttttttgagacagagtcttgctctgtcgcccaggctggagtacagtggcacgatcttggctcactgcaacctccaactcccaggttcaatcaattctcctacctcagcctcccaagtagctgaaattacaggcacacaccaccacgcctggctaatttttgtattttagtagatacggggtttcacaatgttggccaggctggtctcaaactcccgacctcaagtgatccacccatcttggcctcccaaagtgctgggattacaggctgagccactgtgccagttaaaagaaaaaaaatattcaaacatatttggtttcttattgaggtgaagttcacataacatgaaactaacagttttaaagtgaacaattcagtagcatttaattaacaatgttgtccaaccaacacctctgtctagttccaaacatttttgtcaccccaaaaggaaaccacgtgctcagaaggcagtcactccacatcacccctcttcctagtcctatgctttgcacacaactgactcaccctgacagttataacctaaaagttaaataaaattattagtaaactgcaaacccctggcaagtgaattacttaatatctcttaaaatcctgacatcaaatgattcccctgtgaggccatgagatgataagaacatccacctccctctcttgctccagtggaatgaaaccccctcctcaaggagggttacactcaggcataggcccgatcactcatcatatattgacagatgtgcaggcctgagaccccgccttctggagctttctaatgctccttgtttctcaatccaatccttgctaggaattaggctcttctgctgaatgtaaaatttttccatctgcctccataaagtatgtgccacctgtcagctgactggtcaaccccaagctcaaagtatatggacattttgggggtgacaatggtgggcatacatctttagcaaagattaagaaggtaccagaggaggaccagcacaacccagcaatgcagcagaatccatcaggaaagctttggctctgggtggagctccttgctttagctctgcctttgagcgcttgggtggctggggaggcactggggtggaagggaaggaagcaggaattcgtgtgctgcaaatttcactacacttgaccacaacttggagtggaaagggcactgtggtacgtctatctggccttcctttacaagccttaaaatgctgtggaatccatctggatggaagacgccatccaattataaatccttaggatactttttattgccctttaagagttccgatgcttgctcttccatgcccatatgtttctgcttaagaggcttcattcaaatcaaattggaagagaagtccagattacccaactacaattacctgagcaaaaatcccctcaattatcttggtaatccagataaattcggagtacaaaggtgagttgcctggatagcactggctaagaactgctttgtctcccatttcaccttgcattattataatctacttgattacacttcatttataacaatagggagggcttgttttatgccacacattgccacttgctcaagtgtaaaataaaccttaaatgactgatgtactgctaaatttatctcaaaaaacaatcataacaggaatcttaaggcaataaagtcaaacaaatagaattttacagaatttaaaaattattttgtgagtgatttatgctaaaatacctcaaatttatttcaaaaacagtcttacttaaaactgacttaaaatatatgtaggataaataatttgtagtgaatttaacgaaacttcagcaattcaaatgaatgcacattattcttcttaaaaacagatatcctgaaaatatccatcaggataaatagctaatgcatgtgtggcctaatatctaggtgatgggttgataggtgcagggaaccaccatggcacatgtttacctgtgtaacaaacctgcacatccggcacatatatcctggaacgtaaaattaaattaaatttttaaaaagcagatatttggaaagtaccaatagcttcaaagtaaaaatactctacactgtttttgtttgtttgtttattttcgtttttgtttttcttttttgagatggagtctcgctctgttgcccaggctggagtgcagtggcgtgttctcagcttaccacaacctctgcctcctgggttcaagtgattctcctgacttggccgtgccaccatgcccagctaatttttttacatttttggtagagatgatggggtttcactgtgttggccaggctggtctcgaactcctgacctcgtgatccacccgcctcagcctcccaaagtgctgggattacaggcgtgagtcaccgcgcctggcctatgcactgttaattttatcacgacagttataaatccatcaagatgtcctgtgatttttcaacacaaattactcaaattatgaacttctctgtgtgtattttccactggcttgtttatgaatcctgctgatatgtctgctacaatttctccaaaggctaaaagatgtttacaggacaaatgacatcatgaccatgtcaggcttaaatgtgtttatatcagttgggtttagagggtcttcaaaacatggctttaaaatctcagttattatggagcttaatgtgttcctgatgtttctggagtaatgtatttctaaaaatagagaaatagattggttaaaagaaaatgaattgttggtctaatctgtcttatgcatggctaacgaaatgcattttcactctcttccgtgataatacgacacttaaaactgtgaggaccaatggggtgataagagacaaaataaacagtaaatagatactccatgtgagttactactctgtaatagatagaaaagatattttatagaaaagggaaaatacccacagacatataagcaatgtcctgtggttgctatcaaatttactgttagctgtttaaaactgccttaaaggttttttaaatgtgtcttttctaccatagattctttagacgacagccatcaagcagcaaatacctcgcaggaggccattgtgtttctatttgaacttctatggatgtcaagctctgttcttcaaaatttagccctacagatgggtggcccaccggagagaattaatctcactatgcagccaacactaccctttctggatctttccccagtagtgtggattctgctctagtccagaattatgcagaataagtatacttcatcttagacaccataattcttcaaatatctaaaatgtatattatgctctccaaatcctggtcatctccaggttaagtatctctcaaaaacagtccatcagataatatgattttaaatctttatccccttggtcatatacccacaatctcattctatttaccaatatccctactgatgcataaactacatatgtatatgtgtgtttttttttaaaaaaaaagcaattccactgtaattttagcagaggttatttccacatagagctatgtatatgtgtatatacacatatctttatattatatagttttctgtgctttcccagttatctacaatgggcatatatgacttttatagccaggtaattcaatattcattcattcagtgaacatcattgagcatccactatgggctgggaagtgaggatggagccacaaacaagcaaaataaaaacccctgctcttgtggagttcccttctcattggaagagacgtacagtaaagaaaaaaataaaagagtaaagttaatagcctgtgagaaggggatataaaagtgggaaggaagacagggtgatgtgtgagaaacactttttttttttttttttcagatgaagtctcactctgttgcccaggctggagggcagtggctcgatctcagctcactgcaacctccacctcctggtttcaagcagttctcctgcctcagcctcccaagtagctgggacttcaggcatgcaccaccatgcctagctaatttttatatttttagtagagacaggatttcaccatgttggccaggctggtcgtctcaaacttctgacctcaagtgatctgcctgccttgacctccgaaagtgctgggactacagcaatgagctgccaagcccggcctggggaacactattgaatagtgtggtcagggaaggctttactgtgaaggtgatgaagacccaaagaaagtgaggaactaagtcataaatgatgggtagaacattccggattgcgggagcagcaagtgcaaaggccctggggtgaggaataccaagaatgtttgtgtgggcagagcagaaagaaccaagggtaaagcattaggagatgaggctgaagaagtaaccgggatcaggtggttagggccctcaggccctggaggaaggctggcagcgctggagccacatggactgacaatgtctagcagtcatcccggctccctgtgaagaacagaccctcgcttgcagagaagcgaggacaattaggaaagcagagtcatgatccacgcacaggatcacggtgacttggaccagaaagagagcagtggagctggggagtgactcttttcagtatttctcaggtggtaccagtgggatctgcagagaatacatagttaaaggaaatgtctggaactaaacatgactcttcaaacgtgatcctactgtggcagaagagaggcgactttacatttcctttcccaggatatcttattctaatgaacacagaaaccgtaaaatcaagccaaccaacatgatgaaaatgattatataaggtacacagcccaggctggatttgaactgatgagggaaaaaaaatctctagtgaaaattcctctctctaaccacagccttctctccttccatctctgcctcacccttgctctttctgaagccttcctggatgctcatgaagctctctccttctttgactcatcctattttcccaggacctttatcaactcagggctcttctcccctccccacagtcagctcactgtgctctgactagttccctgaaattgctcatcctcttactaaccaggaagcttctacccgctcttggtcttctttctccaccccagtgccaaagaactaagcactgatggagaaaaagcatgcggctaatactgtctgtctctaccacaaatctcataatttttaaaatccatttggaatttacattcactccttaacttcttttcattcactcctaattcacttcctatataattctctacacagctgctgaaaaccttcctttctgctgcctcttaccccaaaactactctcacattactcacaaaggttgaccttgttttctatatacttttttagagtaacgaagccataaaatgtaagttctttcaacctggacctcccactcttgggatttctcaatagcttcacctgtattctcccccttcactcttgactcagaggtaaacgctcccttgctcccaaatcctttagcaacgtagggttgataattgctcctttccaaatttaatccctgcatctgcgcccctgagacagacactgccatgatttcccagcttgctgtcttctccctcctgcatctcctccctttctctgtgacggatattttccctgtgcaagagaaatttcttctgccctaaaataaataatccaaaacatctcttgactccacttaagctaacattcaatatctcactttcccttgtattaacaaaagttaattgagtcagtacggtgctacaattctcagacacaacgataaacatgatagagaccatcaacatgccttggcattttgcctgctttctcttcaattacttgcaacttggcttctactgagctccactgaaaaagctttcatgacatgaccacatccaatcccaaagaaactgtccccttgcccagtggtcttcaaaaccctccaactccacagtgtctcattaactccaactcatttcctactaaacatctcttctcagctcttcaaagtcaaagattgcgaaccaaatctacagacttctcctctcttctcctttgggtccaactccatccttctccatgaaacttcttattcctagaaatggtgtctgcaccttttaggcttccaggcttgagcctagagtcatctttaactctttccatacccagactcccaagacccagtcagctgtttaggtgtctcctctgtatgcagcacttactgtcattgccctggtccatctcccagagcccacatcttgtcccactgtctgcaaagcctttcctatatgctggatataagtgcaaactccccctaaaatcccattgaagtttttacttttttctatcttctttttttacttctttttatcttcctctactcacacagaagtgctccaattatgaggaccttattttattccctttactgtcaaacacaaagccaacatgccatacgaaaagatagtactgtgcttccttcagtgccactctagcacgcccactccagcacacccttcttgtgcgggtgtatgctcatgtgatactatcacaggcaacacttactatgcaatacgttttccacaatcacaatatttccacaatattgtgatatgagctcattcttcaggccttgacacaagcgcccacaaacctaagagaatgcattttcatttttatgatacacagttttcgactgctccactctggctgccaaggcattcctcctccaaatcacgatgtctatatcaaaagaagaacaatgagggagagctggaggtagcgctaagaaacaacctggtccagctcccaggtctcatagagaacactcagaacacgcttgttagaggtatctgctcctggcctcagcttctcagaagcaattacacatcttctgggtaaacgtggagtgtgcagcacagaataccaaagctgagcttcccattgtacctggttgttgatctcctcgttgacctccctcagctgaatatttcttaagaacagtgttcaattaatccaactatccctggtggctggcaggatgaatcagttatgacttatttcatgtttgtgggtgggtgtatgaagtggtcctcaaaggagatttttgctctctgcagacagtctgcctgtctgtaggtcacttcctgccatttcctttgagtgggaatatgagccagggtgttggaagaaggaagagtccaaaagatgtctcagggaatgtcccatagccattggcctggtctgccctagataacttctgagccaggtcaccctaaagtgctacatgaaaagtcatggattttttttctaacttgttgatctcaaatgtcgtgatttggcatgaatatctagcttcccatgttgcagctatggatttattcttgccaaaatattggggattgggctggagagggaagaaggtacgaagatgcattctgtgttgctcaacaagatctgcatggcctcaaccaatgcgtgtttgaccatatggatatttacaaaccccaccatcaactcaccaaaatgaagagtgtcttagacttattctcacaagacaagagggaacgctgcctctaaggagtctctctgggacacctgggagagatttatttaatggtaaagcaaggaaaggaaaagatgaacagtgacctgcaaatcattaaagagggcgactcgatcataggcaagggcttttattagtgctaaaattccacttcaaagtttgctgattcatggatgctttttgttttgctgtttatgttgtagaaactgatttgattttcatagacaaaataactaggcatttataaccacatataggtatgaaagaaagataaaatgatgcccttagcccagtcagaaatactcttaaccatcaaaatagttccctgaatctaataggccaacaatattccaacaccagaacctttgctaccatagccagaatttttaagactgcaccactgttaagtagaggcaatttttaatacttagggtctaaccacaaggcataaaatgcaaaaaaaattacataatcctgtactttttaataattaaatgaaaatacatagactctaagcaggaaaatatctgagatccttaaaacggtataatcataattgttctacattggtaatatgtgtgatgatatttttctccaaaaaaaattctctaccatttcattctctttaatttcttctagcccgtaaggtctagcaaagaggaatacctgaaaagatgcaaattgtacccctgtgctgttcaatgacagcaaaaattgcagctccccaaccccacctcttatgtcccctgagcaatctgtgatcacttgagggtgaggacagtatattgccccaataaactggctttccaccaagtaccaccaagaaatcaaaacagcttttattttattgtgtcatcatatataagttaatagttcataattagttcaaaatttaaaattatgttctaaaaataaagctttctaagtcaatgtaggcaacgattccaagatccttatagttttcctctcttaaacagagaccattatcatatgatttttttttttttttgagacggaagctcactctgttgcccaggctggagtgcagtggtgcgatctctgctcactgcaagctctgcctcctgggttcacgccattctcctgcctcagcctcccaagtagctgggactagaggcacccgccaccacgcccggctaatttttttttttttttttttttttgcatttttagtaaagaccacgtttgaccgtgttagccaggatggtctcgatctcctgacctcatgatctgccagccttaacctcccaaagtgctgagattacaggcgtgagccaccgtgcctggccagtcatatgatttctaaagagaaactgaacagttatttgtagaaactctgcaaagcatgactttgggacgggcacagtggctcacgcctgtaatcccagcactttgggaggctgaggcgggcagatcacgaggtcgggagatcgagaccatcctggctaacatggtgaaaccccgcctctactaaaaaaatacaaaaaaattagccaggcatggtggtgggcgcctgtagtcccagctacttgggaggctgaggcaggagaatggcgtgaacccaggaggcggagcttgcagtgagccaagatcgcaccaccgcactccagcctgggcaacagagcaagactctgtctcaaaaaacaaaacaaaacaacaaaacaaaacaaaacaaaaaagccatgcccaagcccacccctgaccagtgaaatctccgggattggggcacaggtataatgtttttataaacatcttcctagatgtttcctgcatccagggtgataaatcatcatactaaaggcatcatctgaaggctcctagagtatagagaagttcagaataaggaccccaaactattgcacatcctgacactaactagctgtagctgtgcaccctggacagggagagatctaaacagctagttatcttacttcaccgaaatctacaactaaagatgtctatccacgtgttatagctttggcttccctaatctagatgttcaatctacttttctgcaatttggcaaagtaaaacacacatatacagtaatgcacaatgtcctgattgttggggtttattatttgttttgcatttacgcttcttaggtatgtaacatgccaaagtcatgggagctgagtcttttgaaacagaggcttctttgggtgcaaatattaattttctatgaaaaaaagagaaagtacaaagaaaagaaaaaacagcagtaatacagaaatgaatatcttccttgtctaggacacagtgttttttttaacctagatttctttgaacacagactgacacaaaaattaaatactattgctccattggagaggtgcaaacctggggcggtgagagtgaggggaagcgagtgagattgtcactacactagcttctggggacatggagacagccagtcactgagcccctgccttcccttggccatgcagatgcctctgataggttacacggaaaaattctacctcacagcagcccatggggtggaggaaaaataggaacttagttgcctacattcttcctgcatccccttcctcattggtcagagtcaccctgcatgtctgggttgtcacctgctcccaaggtgaccactccaaaagtcaggttctacgcccggtggtggggtgcttcatccaagtacagaaatgccaagaggatccggaaaccttttgacctggttgctgagtcacaggaaagaagggccagccctcctgggacaggtaacaggctggccctgagctgtggaagccctcacacccagaaggagtcaatctgctggggtggccactgagaccaagcaggagctgagggtcctggagtaatagatggaggcccatgagatgtgttcagacacatagtgtgtttgtcaactgcaatgtgtgtgtgcccccaaaattcatgggtttaaatccttacccccaaggtagcagtatgaggaggaggggcctttggaaggtgactaggtcataaggatggaggtctcatgaattgcattagtacctttacaaaagggaccccagggagattccctcacccttttgtcacagtgtgaagacccagcaagaagatggacatctatgaatcaggaagagagccctcaccagaacccaaccctgctacactctgatctcagacttccagcctttagaactgtgagaaataagtttctgttgtttatatgccactcaatgtatagcactttgttacagcagcccaagctaagacagcctattatgtatgagcaggtggctttgagataattgagaaaacagagactataactacaaccagccagagatgggatcattgcaaatgggactcgggttcacacaaggtttgtgacacacacacaaaaaaacataaggcagataaatcagcaagggtagcagtcaggaattgacagacgattaatggattgaggaaacagaatagataatttaaaagcaaacctttgtacacaaaagaattcaggaggtgataaaagtaacattttcatatcagttggaaagtaagttattcaatagcaacagaacaatcatttattgaggaaaaataactatttctttcctggttcaatcttggggtgttgtatgtttccataaatttatccctttttttctgggttttctaatttttgtgcacagaaatgttttttaatagtctctgaggttttttttttatttctgtgggttcagtggtaatgtcccctttgtcatttctgattatgcttatttggatcttctctcttttttctttatcagtctagctagttgtctatcaatcttatttattctttcaaaaaaccaacttttatttttgttggtcttttgcatggtttttttgtatctcaatttcattcagttcagccccgattttggttatttcttttcttctgctagcagtaagtttggtttgctcttgttttttctagttcctccaggtgtgacattaggctgttaatttaagatctttccaactttttgatatcagtgtttagtgctataaactttcctgttaacattgctttaactgtatcccagagattctggtatggtgtatctttgttttcatttgtttcaaataatttattgatttctgtcttagtttcattgtttacccaaaagtcattcaggagcaggttgttcaatttccatgattttgagagatattcttagcattgattttatttttaccgtgctgtggtctgaaagtacggctagtatgatttcagggttttttttcatttgttgcaaattgttttatagccaagtgcgtagtcaattttgaagtatgtgccacgtgtaggtgaaaagaatgcatattgtgtcgttgttgggtgcagtgttctggagatgtctgttaggtccatttggtcaagtgtcaagtttaggtctcaaatatgttaagttagttttctgccttgatgatctatctaatactgtcagtgagatgttgaaatctcccactattattgtatggttatctaagtctctcactaggtccctaaaacttgatttatgaatctgagtgctccagcattgggtgcatacatatctagaacagttaagtcttcttgttgaattggaccctttatcattatataatgcccttctttgtcttttttgatcattgttggtttaaagtctgaaattgaaacgctgaacagaccaataacgaattacaaaattaaatcagtaatataaagactaccaaccagaaaaagccctagaccagagagattcacaaccaaattctaccagatgtataacaaagagctactaccaatcctactgaaactattacaaaagatttaggaggaaagactcctccttaacctcattttatgaggccagtatcattttgatacagaaacctggcagagacacaataagaaaagaaacttcaggccaatattcatgatgaacagggatttggaaatcctcaacaaaataccagtaaaccaaatccagtaccacatcaaaaagctaatccaccatgattaactacacattattcctgggatgcaaggttggctcaacatatgcagatcaataaatgtgattcatcccataaacagaactaaacacaaaaaccacatgatcatctcaatagctgcagaaaagacttccaataaaattcaacatcctttcatgtttaaaacactgacaaactaggcattgaaagaacatacctcaaaatactaacagccatctatgacaaacccacagcaacactgtactgaacaggaaaagctggaagcattccccatgagaattgaaacaagctaaggatgcccactctcaccactcttagtcaatatagtactggaagtcctagccagagcaatcaagcaagagaaaaaaaaaaaaaagaaacaaaatacatccaaatgggaagagaggaagtcaaactatctctcttcacagaggacgtgatttatgtctggaaaacctcattgtatctgtctaaaaactcctggatctgaaaaacaatttcacaacgttttaggatacaaaatcaatgtacaaaaatcagtagcatttctaaacatcaacaatgtccaagctgagagccatatcaagaatgcaattccattcaaaatagcaacaaaaaaaatacaatacttaagggtacagataactggggagtgaaaatctctatgacaagtattacaaaacaaagatcaaagaaatcagagatgacacaaagaaatggaaaaacattccatgcccatggataggaagaatcaatattgttaaaatggccatacttcccaaagcaacttatagattcaatgctatttctatcatattactaattacattttcacagaattagaaaaaactatttggaaattcatatggaaccacagaagagcctaaatagccaaagcaattctaggaaaccaaaaagctgaagtatcacactacctagcttcaaactatgccataaggccacagtaaccaagacagcatagaactagtacaaaaacagacacataaaccaatggactagattagagaacccagaagtaatgtcacacatctatagtcatctaatcttcaacaaagtagacaaaacaagcaatgtggaaaggattccctattcaataaatagtgcttggataactagctagccatatgcagaagattgaaactagactctttcattttaccatatacaaaaatcaactcaagatggattaaagacttaaatgtaaatcatacaactataaaaacctagaagaaaacctagaacataccattctggacataggccctggcaaagatttcatgacagactccaaaagcaatggcaacaaaaacagaaattgacaaatgggacctaattaaactaaagagcttctgcacagcaaaagaaactatcaatagagtatacagacaatgtacagaataggagaaaatatttgcaaattatgcatccaacaaaggtctaatatgcagaatctataaaaaaaaacttaagcaaattaacaagcaaaaaacaacttctttaaaaaaaatgggccaaaaaaacatgaaaagacacttctcaaaagaagacatgtgtgaccaacaagcatatgaaaaaacgctcaacatcactaatcactagagaaaagcaaaccaaaaccaccatgagatatcatgacacaccagtcagaacggcaattttaaaagtcaaaaaataacacatgttggtgaggctgcagagaaaaaggaacagttatatgctgcgtgtgtgaatgtaaattagttcagacactgtggaaagcagtttggagatttcccaaagaacttaaaatagaactaccattcaacccaataatcccatcactgggtatataaaggaatataaattgttctactgtaaagacacctgcattattcacagcattattcacaatagcaaagacatagaaccaatctagaagtccatcagtggtggactggataaagaaaaaaatgtggtacacaaacattacagaatactacacagccataaaatagaatgaaatcatgtcctttgcagtaacatgaatggagctggaggccattatcctaagggagttaacacaggagcggaaaaccaaataccacatgttttcacttataagtgggagctaaacactgagcacacatggacacaaagaatggaatgatagacaccaggggctgcttgagggtggagggtagacgaagggtgaagattgaaaaactaccaattgggcactatgcttattacatggtttatgaaataatctgcacaccaaactctcatggcatgcaatttacccacgtaacaaacgtacacgtgtacccccgaacctaaaataaaagttagaaaggaaaaaaaaaaaactaaatccctatctcacattatacatctaaaaaatccaaatagattagatttaattaaaaattaaaccataaaacacagaaagaaaatacagatgaatagttatataatttaggatgagaacagcctctgtcaggatgaactaaagaattcacaaaaaaaaatgttaacaaattaaatgacatgttaaaaatctggccaggggtagtggttcacacctgtaatcccagcactttgggatgctgaggcgggcggattacctgaggtcaggagtttgagaccagcctggccaacatagtgaaacctcgtctctactgaaagtacaaaaattatccaggcatggtggcacacgcctgtaatcccagctactcaggaggctgaggcaggagaattgcttgagcccgggagacggaggctgcagtgagctgagatcatgccactgcactccagcctggctgacagagggagactctgtctcaaaaaaaaaaaattaagaaactatatattgaaagactataaaaaatagttttggtttttttctcagtaaaaaaataatatatccattgtcaaaaattttctattttcaatattattatttaatagaaaaatttcaacaatttctggagaaaatatatgaaacacatttgacagagttttaacatccttaacataaaggatgtaacttatatgttacatccttaacataattttctttgttcagttaacaagtttttattgagtatctatattgaaatatgcactatgtctgacactggcaacacatttgaggaaataaagaagaaaaattcaagtccacatggaaaaatggactaaggacatgaaaaagtataaatcatcagtacacttctaataaagttaataatcaaagaaatgcaaataaatgtgacctatcaaggtcttgctatttgtactgtcaaattataaaaatacaataacaaatattggcagatattggggaaacaagtaatgtcatatactggtatgtgcttaaactggtaaaagtcttcagaaaggaaattggaaatatatgtaaaaattttggacagttgcatattctttgttctagaaattctacttatatgattagaacctaaggaagttatcatagatttaatcaaagatagttacaggatattcaacatagccctgtatataacagccaagaatctgaagccaacaaaaaatatttagcttaaaatgtatagaatatacataggatgaaattgcataggtcactaaacagtttctagggacatggaaaaaaaaatgccatattgcagaaatgcaatattttgggatgataaaagggcagtttcaaaaaattgaaaaaatagcagttactatgacctcttttggcaaaaataattatatgtaatattgttcatggaaaaatagactggaaatataacgattaaaatgttaattgtatctgggttggtgagattacatataattattatatataatctttacttttttagattgttgttcacagtgacatcaagatttgtcatgggagaaaaaatgaagaagattattattttgtagtcacccaaggagagaagaagtcacatctctggagataggaggagatagggcatatgagccaatcacatttctgcagccttttgtggatacaaaaggggtgggccaagcctttccaatatcccttttcctccttggtacccagacagactatatttaccagcctcctttgcagccaggtgtggtcatgtgactcattcctggtcaatgaaaggtagatggaagcctggcctaggaaacaggtctacatgcaatcttccattcttctcccacccactggctgaaaagaaaggcttctgaggacacagagtggggggaaggctaggtagaggctggatgggaagaaagcagggttctcttgctcctctcatcagagagctactgaggagacccaccgcacccagacccccatactggactgttacaggagtgagaaataaactttgtttagaccactgaaatttgagagttagagctattagcctaccctgattaacgctggggtagcccctcacatctgcccagcaccctcagcagagcctaacccaatcatccaaggttacccaatagagaactcaggcttccactagagtagccgtcacatagagttactgggtcttccaggttctgccacctccaccgtgttttgtgggactctccactgaactcacaaagcacatgtattcagctactccaaagctatgtgtactcaggaagagaaagttctaaatgtttctgtgaccttgtgccactgatatcatgggttctatccttcagagtgctaagaaaagtgttaaatctccagaatagctttggaaaagtggagaaatttgagactttctctatttttagttgctaatatgcattcctgaaaagtttatttaaagccacaaggaaatatttccatattgaatttcaatattgcaatatactattttagaataaaatggaaagatccaggacatagagcagctgagaagctacacagttggcccctgggcttcactcagacagtgcttctctaggctgcaagtcataagtctttgtgtcacccacttttagaagacatcccccggacttctgggaccaacctgaggtttgtaggaatctctgaggatcaatgatcaaacatatattagcttgaaaaaaaactaatatatgtgtatgtttttttaaaaggttaagtttttaacaatttagacgtcttggcattatactctgagaacgttaaccaatgagaataagagtgacaatttagatgtaaaacctcttaaaggtaaagataaaatcctaaccacatggggaaaaccatgtgttctgtggatgatttccctggatttctcaaaagactcttagaatgttctgggtatgactttgggggcatctgttctatgaagatgggcaccccagcatcacctgcatattaacccttcttcttgctcctaaagatgcagaattagctgagattaggaagatgtacaaagtgttctccctgcacttcaactaatgaacaaaactttttaaaaattacttatgatttggaactattttatcattttatatatcctatggcaactggcattttatatttaattttatcatcttttgctttttttctttgatctaaatcaggatgctaagttttgggggggggtcctacagttttggcagagacctcattctaaaaaagaggtaccagactattaaggcagaatctgctgagggtggccccaaacctggtctggtgaacctcactcaactcatcattgatttcaagggcacagaagaggcaaggagatgacagcaggagaaatggacatgtaccatggagaaaggggaccaaccacaccttctgtccaaactgagatttcccagcctgaaacaggtcaacactggggttagcaagaaactttaaactgaataggagattaaagtaataagaagatgagtactattattggtacaaattatattggtaatagttttaagtttcattctttaagacagggtgaatcacagtcccttctctcaaggtccttgtcagcattctacttttccaaggacattcaaaaatttctcatccaaagtcaaacattagtgtgtgtgcctcaaacaagaaatagttttccatcagtctccaaatctttgaatagtaaatggcaaaagtatggaaatgcaagatggagtggggcttaatgttgccacaacattcctacaatactgggatagtcttccttgggaattactttctttcctatcacgtatcaataaggaaagccaaatgtagaaataaagaaatctccccgatttacttaacacacggaggtgacagttacagcgcaaattgagggaagagtaaatgatttccacaaatgaaccaaaaacacttaaaagccacatttaagagaaatggagtcataaaggcaatatttgtgagcagataaaaaatcagcacagaaaaaggtgagaaatacacaatgtctttcatcaaggtgcaaggaaatgtaaaataacattaaaagtaccaactacataatttgaatataaagagaacaatagcaagaaaggagaggggaagtgatggcgatatggagacacagtctcttttgcatgcacagggcagaaccggtgcctcaggctggagggtgtctgtgagtaccccacaatgaaagcaaaagagcacccagcattgaagccacagaccttgctccatgaatcctagctgatgggctggcacagagagatcaggagcagaacaaggaaatccataggaggatcctcccaaagtacttttttttctggtccaaaaatccttaaatctgtcagaagcaggaggttggagtgggagaattgcagagcctggaacacacctgcctgctgatgacccattctgagggggttctttccacttggcagcaatggacttggtaaaaaaaataatagatccttctccatggatcccatttccctttttttttttttttttttttttgagatggagccccaggcagaattaaagaccaactctgggacccaaatttttagaggacaaaggttgatataatggccagcacgatttagtcatttagatttcaggtctaactaactgatgacagactttaacaaaatcactgaaagaaatttaacgtcaaccttaaataacagtagaggcaggtaatataacaaatagagtcaaaatggtttatctaaaggtctaagcccaagaaacatccaacaataaaattaatctaaaacaaattttttaataatcatttttttttcttgagacagagtttcgctcttgttgcccaggctggagtgccatggcacggtcttggctcactgcaccccctgcctcccgggttcaagtgatttcctgcctcagtctcccaagtagctgggattacaggcatgcgccaccacgcccagctaatttttttgtatttttagtagagatggggtttcaccatgttggtcaggctggcctcgaactcctgacctcaggtgatccacccaccttggtctcccaaagtgctgggattataggcgtgagacaccacacccggcctcatcttttctttaacattacaatttcccatcatggtggcacttgacagtagtgggactgtccaacagcaaatgaccccatctaagcactcaggacagaagccattttaggtcatgaaaattatacagattttgtgagtgaagggcatttagttctgagcagaaagtagtcttgcaaaagggaaatttgcaacaacaacaaaaaaggacaaggagggtgacaatgtcaagcaaatgataaccctgctggagcttcagaaggaaccagctacatccctttcctgcttctacagatgctatggcagccccagaggtgtcccactaggatctcccttcaagaaagaatctagcatgcatctgaacaacctccagctgttcacacctcaggccctgcctcatcccagacagccctgagccaatcactgacacagcagggtactagagcctggtcatttctgcccaacccggggcccctccaaaggcaagctctgctccagacctccccgttgggttggtcaaactatcaaatctgtacctggtctgaggctctccctgcccagtcttgcttcatcctcattttatccttcacaggcacagcccccttccccctccaataaaacactaacattcctaattccgtctcaacatctgcttcccagggaacctaactaacacaatactcctaaaaccaataccagcaaaaagtgactttccaagcccctacatgaagactcattttctggaaaataaaatttaatataattccaattacccatgacgctatttagccatttcaaaggaaatgagaaagcttcccaaattgtggtcctcatggagtgaactgatcatcaaatgttgctgtttacatgagggcacacaataattagggttgtatgtaacatgctactttcagattttcaggtaagtctaaatgcttttaattgatgcaagaataataagtccttcagttgatttatgtcatgcattaatatcaatcaaaaggttttctaacacatactttttaatactataaaatgtggggttttttttaatgtcttttttttcttattcagagccacatttcttcacatggtatgttttacctaacctaagggttatgttgttcgtttgtttttaatttcaggtttgaggaatcaagtaacaggtctttctaaatccttttattggatatatgttagttttccattatcataaaagactgaggaacaggaacagcagcatattgtttaaatgattcacaggtaaaaatatcttctccctcttggtctgttttctttcctgatgtctttgctcattgccaacattgtctattttatatataattcttgcaggacattgtgccctgaaggtgaaattggacaggtaaggagatgacccaacaccccttgtcacacctgcaggctctaggtcacttttgtaacacacaatgaaatgggtaaattctacacaatcctttttttttttttttcaaacaataacagaaagtaaatatttgaactgggggctttttcaaacaacacaagtcagaaaaaattgacttgtttttgactgttactttaggcatatatttttgattaatgacaattaaatgtaaatataaagatattttaaacttgaggttttaaaacaaagaatgcaagaatcacctggttaaagttagatattttgtcagtctcaaagtcagttggctggataataccatatcataaaattttataagactaatttgaaggtccatatgaattggtattattgttcgtttttcaatattgatcttagcagtgtatttacagcatacagcagagttaatgtttaatacaaacaaacaagactttccagaaaatctacaaagaatcactaactaatagccatgcttcagttaaatttgtttactttttaaagtacattctcagaagtaacatgtactctcaattaagtaaaacacaaccagaattttggaatttgatctttaaaataataaaaaaactttctctgctatttacagccttggttaaaatcccaacatctggataccagaatctgagcagcaaaatccacggagacacatgtgcaattttatgcctgcaagctcactattatttagaacgaaaccaacgtagtgcatctacccttgtttcttgctacacagaatgtatccagagtacaaactaatgtagattattataaaactcagtgtgtagatattatatatatatacacatgcatacatacacgcacatatataactaaaacaaaatcttcaaaaataatactttttctttctgtatgtgatgtgccctgatagtttccactttactccatcccatttccttttgttaatactggccttgactcacttagacaaatgggtcatgacctgtagtttggaaaacagggctttccagcctggctttaaagaggctggtcctcaggccagcagaaccagcagcacctgggggtagtttgtggcgcacaatctcaaggcctgccctagacctactgaactaggatctgctcttagcaaggtccccaggtgacttatggatgtattaaagtttgagaagccgtcctcctgcatgcaaaagtacagaatgagtatctgtgatctgaactacatttaaatcgataatgcacctcttaaactgtctttgttcaaagaacttctatcctactgagctcaaggagcaacacagtttctagcaagataggtgcaaagaaaaattcactttcaatttcatcaactgcttcaagaggttgcagggactggctgacctggtatcccagctcctgcaggaccgagagtgtgggaggtgggttgaggggaggtactgaattgactgcaatagatccatgagcatataaaagtgtgcgtgtttgttcttattcctgggagaaaatatatagtattcacctaattttaaaagagttttatggtttaaaaagttaagaagagctactaagccatgaaaagacgaggaggaagcttaaatgcacattactataccagataagaaaatctgaaaaggctacatagtgtatgattccaaccatatgacagtctggaaatggcaaaactatggagatgtaaaaagatcagtggttgtcagggcctaggaggtcgggagggatgaacagacacagctcagtgaatttgaggggcagtgaaactaatctgtatgatattataatggtggatccgtgtcatcacctgtttgtccaaacccacagaacatataacaccaagggtatacggtgtttatattaaagtataaccctaatgagaactctggactttgggtgataatgatgtgttgatgtaggttcagcccttgttacacgtcagccacccatgtgggaaaatgttgatagtggtggaagctatgtatgtataggggcaggaattatatgagaacacttgtggtatatgctcaagtctgttgtgaacctaaaactgctctaaaaaataaagtctgtaggtatctatgaaagcgcagacacatggtccgtgagagcacgtcctctctgctataaattggttgtatggttacaatcatacctagaaaggagagaaaataaagagtaagtgaataccgacatgttcaattctgccccagaatacaacaaagtccctgaatcactcttgtttcattgttgccattgcttattcaattcagtcaactcgtatatgtgaagcatgtgctacatacataacgtataatgcaggatgcaaaaatgattatgtgatcacttcaagtaatttataatctagcaaacatataaaacaggcacacagataatccttacatagtaaatgcctcctttttccccaaaatggcaaggagacaaatagcaaggatccgaggacagagaggcaaaattcagaaggccagaaaggcatggagccagaaatccaattcactcgcgagtaaggtatcgggagagagtggtgtacaacgtgacagggacacctgttgctcccaattgtaatcttttctgattggtttatgcccctttccaattactgtgtccatgctaattatcaactatttttattatcaaccctgcagaggggactaagagaaaaaaaaaaactgctgcaaagtgatgctgtgttcattttgcacagaacccagaaatcctgatgaaggaaactgaattggatgccacaagccttatctcctgtgaatgctgaatgactttgtcggtgggttttacgataagatgtactttcttttatatctattaaacaagctatacagaatactggtaaatacacagaagtaaaaagaagaataaaatagataaaattttctaagttaaaagctaagggaaaaataaaaagaattatcaattgatgtgatcaaagaaaaatgtttatctcatggggtgttggaaaaggaacatcataaaaattaataggtagaataatcatcaaaaacaatctgcacaacaaatattacatagctgaggggaactatcattaaaatataatgtatacaaattgctgagaaactcactacaccttctaaatcatgtcaaaagagttgtttgcatataagctgtctgcacttcttctctctctctctttttttttgttcatattcactgcaaggtggcttttgtccacccatgcaaatcactcatatgaaggtcacaatgatgtccaggtggccaaagcctgtggctaatcctcagtcctcatctcaccgagacagcagtttcttagcccttctcctacctccactggcttctcttctcagctcctctgtagttccccctcctctttccaacctgtatgcattggaggggcccaaagctcaaccctaatgctcttctgcatcttggtccctaggtgatctcacctagtcacccagcctcagatagccttaggcttaggaatcacaaatatatctctcacatgacctctagactcatatcaacctctcaacatcacaatttggatatccaacaggcatctccaactcaacacagccaaaccccacttttgacttcctgctcattgcaactgtcccctcttgcagatgtcccttttagagtaggtggcaccatcatatacccagttacaaacaaaatctttaaagtcatccttgactctcctacactgcatatctaatccatcagcaaatgctgtcttttccaccttcaaagtagatccccagtctgatcatttctcactacctcccctttcgctgcctggtgcctggcaatggcctcctaattggtcttccctgtttcaactcttggtccccctctagactgttccccacacaacagccaacatggttcttttagaacttcaaccaatgtaaattatacttcaagaaagctttaaaaaattcaatcagatcacatctgctatgaaccttccaatggttctcctcccgcagtgtgccaaataaaatggaaatgcccttatccttgcttaacagaagtctacaacacagcctcaccagcatgcctccaactcacatcctgcagctttaacctcactccacgccagcccccagtctccttgccgttacttgaaagtgccaggagagctcctgccaaagggcctttgcacatgctgttccctctctctgcaatactcttccccgtgtgatcatacggctcatgctcccactcccttcgggtctcagcttgaatgtcacctcctccctatgaccttccctaacctttcgtgtaaaattctacctctcccttcctcagtctcttgcttctcctgctttgttctggagaataccaaccagcaccacctgatttgtaactattcccttgagcacattctatctcagccacgggaatggaagcttcatgcaggcggggacatcatctgttcagttcatgctgtagcccagcaattctgaatgattagattgaaattggatccaaaaatatcacaaatgagataacgtaacttgttgataagtgtgtgaagagtatgaagagatgatcaagctcacaagtttccaagtgctaacatctataaaactccattgtcacccatcaaatcagcaaagattaaaaaccacaatagaatgtgataaaatagtgctctcagatacttcctggagaagtatagatgggcagaattgggtgatctggtatcaatgatcattctttcataccaatacaccatgggattttgcgatcagaaggtaaagaagacacagaaggaaaagaaggtgaagattaaaccagcaaaaacccataataagtaggacttcttcctattcattagtaagaaagagttgggtgtccccatgggaaaatgctaatttagtgtcctgaaccactgtaccctccaattcctgcttcccccacaacagtggccccacactgagtcctacaacgaggataatgatcctcaacccccaattgcacagacagggctaagtcagagacagtgatgccaaccttgctgatgtctctaaaacactcaactactgggggctaaccctaagcaaaattattgactccgattcctaagttaatttcctataaggtggaagaagcaacaagtgtcacttctcttctgggctctatgacaccaaatagtggagccgaagagacttgctgatgttttgaaacccaaggccaaataatgctctctaaacccttagaggtgtgactaggatattcacagaagccacgcaaaagacagcagccttcaatgaagaaacaaagaaacaaaaaacatggttccttttataaatatttatcgattatctaaggctaggttaattgttgataactatcaattatctgagcaagatacgcagaaacacttcaggtgcttgaactgcagcatcctgggctccaacccaaacttactggagaagaagctttagataccaggaatctgcattttaaccaactcctcagggaaactgccccagagggggtctaggctaaccatgcgcaacttccacccattctcctgggaagtgattgtgaatctcctccaaacccctcttacacttcctgattaagttggtgccccctactgaatgtcagcctcactgaatcttaacgaggaatcgccagactgggggggggattgtgcagcatgtctggggaacacttcactacttcactaaaccctgctgcacacatgctgaacaccgttccaaaggctacaggaactgagcaccgcattggaatctggccctggagggtgcccagcatggcgaccctgaggggtgcaggaacccagtgagaaggagaaacagaaggtacagtccagctcgagaccacgcacataaagaaatctgtaggcagggtctctattattgtgccatattaaatatcttgatattttaaagcaatattatttttctgattataaaagtactcattgtagaaattttaattgtgccatcatcctgcagaaaaatgaaagtacaaaaaacgaaaaagcagctatacacggccacaaagtcacagggctcatcgggatgtgctaaccaggctggaaactgatcaaagctgatttattgagaaaaaataggcagcatatcaaagacttacatcagcttcatagtagacagactttgggggcgggggaactctgtctcttttgagtatattctcaaaaggataaactttcaccttcctgtgaagcacagttactataaatcagatttgcaaactgtgagaaatgcttacaactcaatgagtcttttgtcagccagtgggggctccatcgtgaaatccacccttcgccatagcgatgggataaatcatcaccagccccgagacatcgcctaatcccttcctcgcaaggcagattcgggcgctttctgcatctgcttcgtgttattgaaaagagctcggctcatctgctgggctctcaggcttcacagtgacctcgcacagaacgctgctacttctgaaactgttttagactcttccgtctatgaaacagacacagagtttaagtttagcgtcttttatggtcagaaatatttagcgttacttccagagcggcagccgtggaacaatgtgggaaagaagtgcttcagttcacttcttgggaagtactgaccctgggtcaatttaattttttccgtaagatttccccttcttacttttctccttccactgctatatgtaacagtatctccccttccactgctatatgtaacagtatctccccttccactgctatatgcaccagtatgctagtatacaacattatagattaataatatgctatattgtttaaaaatattaatgttatataattaacatggtgtgcatattattatattgacaatacgtaatgtgatgtgataataagtctcactgagtgccaggcaccgctttgaatgctctaaactcattagctaatttattcctcgtgattctatggggtagatgcactatttcattcccattttacagctgaggaaactgaggcagctagtaacaggtggagccaagcttcacactgagatcatctggccccagcacactcataaaaatgagcaaaagtataaaagccaaagggaaaaggaagccaaggggtgaaaatcctaattacaaacaaatcctgggtaagctgggtttttagtccttccccacatgtgaacagcaactagaaacctgaacagtgactttgtttcccctgtcatccattgttggtgcctgatcctcacacaaaatcttacggagcagtatctagtgattagcttagctgaattgagcctggacacccttcatgagctggaggacagaggacgtgtcgatggagggtccaacttcaggcatctgtactcgcctgctacaggtgagtggacctatgaacccccagcctcatcaagcacccgagggtcacctgcctgcttcacctggaagagacagcaaggtgtgatcccaggaagatcctctgccaggaggcttacaggcagaagcagcggctgctgaacatagatgctgtcggcaggacacaggggtgatagggggtgagccagtggagcaggtgaaggtgcagactacaggcagcccccctgagatcctgcccagaccccagcagcagctcccctgtccctctctagcagcttcgctgtgcccgaagtgtttgagaacaggtgacccatgccctgagtggcagatgctgtgtctttttgatcccttctctccctccccccccacccccagtggggtacatggaaggtttgctaaatgtttgttgaatgaataaacgagcccaagtcagaagcagtctccaaatcattcctcatcgcaaaagggtgcggtggaaaaactcacaaagccaaggcaggaggacacactcaacttggaaacggcccgtgcccagctttggaacaggcacagcctgagcttcaaggaagtcacttgaccagcagtagctcccacctttccttgcagctagaacagcatcagaccaagtgatctctaatgtgatgatttgctaaagtacaatgagttttacaactagaaagtaccttcctctcaagactgacttcactatgagccacctaatttttcctctctcttcttttggtatttttgttgcaaatagtacacacaaaacaggatatataatctatttgtgcaatttaaagaataagaagcaaacacctttgcaggtactccctagtccacaacagtcagccccaggacctcagaagccccttatgcctttcccctaaaactctcccctccctgacaaggtaattccaatgctgagttatgtggttttttttccttatttttcttttcaacacatattacgtttctctgaataatatgctttttaatgttgcctctttttaatctttatttgtggaatcatattgtatgtaatctgtgacttttttctactcacatatgagaaccatccacactgatacatggctacagatagacacttggagtttatttttcactgctgtatagtactccattggtggagtacaataggtttatgtatccacttttctgtagatggacacttgggttgttctgtttttgctcatacatacctcctggtgctcaggtacaagggaatacagacccagggtgagactgctggatcacaggctaggcacatcttcagctttactaggtaacaccaagccaatacaaaagtgcttgtacaaactcatgctcctgccagcatggaggacccactgtgccacataaaaacatcactgttattaacttgttttatttgcatatgattattttttcccttatccccaaccacttctcaaagcaactagccagcatgtgccacacaggcaagcacccactccaatgtgatctatatggttaggtatgtatgtaccctggaaaaccctgtgatgttgcttgaggagtatataacttttttatgtatgtaagtagcatgtgctacaaagcgcgttctgttttctgtatttttcactccactcagtgttttgtaaaacatgctcatgttgctccataggtatcagagacaggatgatgttttatctttaagatgggtacgccaccctcattttatagatcacagtgatagctcacaattgtttagtactcagtggggtctaaatgtactaactcgtttaatctcccacgaaccctgcaaaacagatgcttccgtttcatataaaatgagaccaaggcacaaagaaactaaggaacttgtacaaaatcaccaagttagtaaacatcagagcaggatttgaattgagccagaatgtgttcttatccacgacatgaaactggataagaatgcaaagctcagagaattttcatgactagcatctctgggattcacagctggcgaccacggagcagaactaatatacagatggttcccctctcagtccagtcctcattccatcggctccaaaatgtgtattattctatatgattagctggtgaacaacaaaggcaattagttagtcctcttcagcaaatgttagtaaatgaaaatattatagagacagaactctttttaggaaatgcaatcatgtgaatttaaaaatgctttatcagaaatagaattaatgacaaaaatatttataggatcctaagaaaatggatttgctattttttttgtcggctgatgataatcatctgggtgcatctttggttgtgacagctccaccccttcagagagttgtatcttcatacacacctaacatgctaagagtagatgtgcatgatatggtagttagtataatttctgtaataaaaaaagtacttggtcatgcctgtaatcccagcattttgggaggctgaggtgggaggattgcttgagcccagagtttgagaccagcctgggcaagatagtgagaccttgtctctacaaaaaaaataaaaattagctgggtgtagcggtgcacacctgtagtcccagctactcaggaggttgaggcaggaagatcgcttgagcctgggaggcagaggctgcagtgagccataatcataccactgcactccagcctgggcaacagagcaagactatgtcttaaaaaaaataaataaaaataaataataaataaaaaatttttaaaaaaggtacctggaacggcctgcaaagaaagggaaatcaaattatgcttcaagacagtcactattatcactgacagagaagcagctaaaataaacagcctgctcattttgtttgtaaatgaattgccacaattcttgcactatttaaatcaagaatattttatattccatagttttcaaccacccctcctttttttattgtttccagctccttaaacatataaaaggataaaagccatttgttctggcagaaaagagtcatcataaattttgcagagtgaatttctctaagatgaaaggaatgttcctctcctccaggacagcctacggacaggactgtgatgacacagagtcttcacgggaatcacacctgcagtgttaagccacttctgtggaaaactcaagtccttctcagataacaaaaacattttagtagcaatgaaccaaaaacaaaatcttccactatatatgttaatacatcaaaaggaaccattcatgtgccatttataagaacttccttccggccaggtgcggtggctcacgcctgtaatcccagcactttgggaggccaaggcaggtggatcacgaggtcaggagattgagaccatcctggctaacacggtgaaaccccgtctctactaaaaaaaaaaaaaaaaatgcaaaaaattagccaggcgtggtggcaggtgcctgtagtcccagctactcaggaggctgaggcaggagaatggcgggaacccaggaggcagaggttgcagcaagccaagatcgcgccactgcactccagcctgggcaacaaagcgagactccatcaaaaaaaaaaaaaaaaaaaaagaacttccttcccagaaatcatagcagcgttcctcagcccaaagccagaagaaacttctcgcacatgaaattttacttcaaaaactcccatatcaggcattttaatgaatcagtggaagaaaattatcctcccaactttgttgtcaagaaccccaatttcatatgcagaaaaaagaattacaaaaataattattcgaattctaattggtgggattttgataggtttataaaggaaataaatatctttaacacaattctacctcgcagccaacatcagctattagcaaccacacttcttattgccagttcatctctccaaacacacagaagccatgtgagttgaaatttattttttaaaaactctcagttatgatttctcaaaattatatttcatatattgacatcaaccaatatgatgatgatattatatattgacattaaccaatacgatcaaccaatatgatgataattgtagggaaaagaaagagagatctgactgttactgtgtctatgtagaaaggaaagacataagagactccattttgaaaaagacctgtactttaaacaattgctttgctgagatgttgttaatttgtagctttgccccaaccactttgccctagccactttgacccaacctggagctcacaaaaacatgtgttgtataaaatcaatgtgtaagggatctagggctgtgcaggacgtgccttgttaacatgtttacaagcagtatacttggtaaaagtcatcgccattctctagcctcaataaaccaggggcacaatgcactgcggaaagccgcagggacctctgcccttgaaagcggggtattgtccaaggtttctcccatgtgatagtctgaaatatggcctcgtgggatgagaaagacctgactgtcccccagcccgacacccgtaaagggtctgtgctgaggtggattagtaaaagaggaaagcctcttgcagttgagatagaggaaggccactgtctcctgtctgcccctgggaactgaatgtctcagtataaaacccaattgtacatttgttcaattctgagatgagagaaaaaccgccctatggtggaaggtgagacatgtttacagcaatgctgctttgttattctttactccgctgagatgtttgggtggagagaaacatacatctggcctatgtgcacatccaggcatagtaccttcccttgaacttaattatgacatagattcttttgctcacatgttttttgctgaccttctccttattatcaccctgctctcctactacattcctttttgctaaaataatgaaaataataatcaattaaaactgagggaactcagaggccggtgccggtgcaggtccttggtatgctgagcgccggtcccctgagcccactgttgtttctctatactttgtctctgtgtcttatttcttttctcagtctctcgtcccacctgactagaaatacccacagttgtggaggggaaggtcaccccttcagataataagataaatcagagccgaaaacatagttcattcctgaaatcaaatatagaacgtttctaccaacacacattttcaaagatggtgttttcaggtttgtatgggattgtttcacctttatgaattagctttttaaaacctgtaatactttcttgctgacttcatcatttccttctggttgcctggaggggtggtgtggaatgctaataaaatgaatttcagttgccgtccctcacaatctgaactatagaagatatttattgtctcaacttccctatgagcttttctttgcatcatgcagcttcatggtcagcagacactaaaaattaaagaaagtctttctcccactttacttgtgtagcacagacacactgatcaaatatgttcccagcacttccgaagaaaccttatcacatccacaagagatttcctacttgcactttttttgataaacacaaccatcatagcccaacaaaacatcacacagaaatcaaattatagtgtccccataagcatctgctcctctatggccttgggcaaaatttagaatcctcgacatccctagagttaccacaatctctgaaagtgaaggagcacccacaaagctcaaggaatgcattgaaactcttattacttccaattccattttcaaaaaaagtaaatgtgtgtgtatgtgagctgcacatggtccagaatgcctcaccaaatgtattgttttaaaatgtgtgtacgtccatgtgtaattgtatgtgtgggattttgaaaggctttttatattttattcaaaaaggtacacttttcaatatcacaaactttgctttcaattataagcccttcccattttcaattaatgttttaggcaaggaatatacattagtaaaaccaaccacaccacttagggaaaatgaattagtatggggaaagtgaagaactggccatgcagtcaattactttggccagcatagatatagttgaactaaccagcacaggtgtagacagcctgtttggataaggtagcttaagccccaattttttctgcagtctttatttttgtcaaatatatgaaaactaccatctcatttcctccctgtagctattacccacatgtatgtgtagtgtcaaaataaatggccagagtcctctcagggacctcccttggcacaagtcgcacttcctcaccctctcacctccagagcctcaggaagtgcaggtcagaaagcagccagggcaggtgtgaggtgatggagcgctgagtgtcggcgagcccagataaaacaacgttccaacatcggaaatccaatcattcacctacttgtctcctgctcgctaaccccaggcaagtataaaggagatggaattataacaggagttagaagaatttggatgtgatttcatatattaactcagcaaaattttttctgaaaaggtccagacagtaaatattttcagctggcaggccatatggtctttgtcgaacctactcaactgtgccattatggagtgaaggcagccacagatgatatagaaatgaatgcatggggctgtgttccaataaagctttctttatggacactgaaatgtaaatttcatgcaatttacatgtgttacgaaatatgcttcttttgatttttcaaccatttaaaaaagtaaaaaccattttcttagctcctgggctgtgttgactgacccctaattaactgatatgtgggctgctatccatgaaaacctaggcacagaggaaggcagagctggcttcccagccaagacgggacttaccttgatatgagctgctgggtccgggacagtctgaatcatgtccttcagtaagccagcccatctaccagctgttcagaacctgacggctagaagacaaaaggaacaacatacataataataaacaactgcatttctgtgttttatgttctagcaggacaggacacaattcaccaatggcaaaagaatcatagctttacattaaacatgtttgcctaaaggcatcctctaggtacgtgtggtccatgaggtgactagataactcacttcccttccattgggaaaatcacttacaatgagcccaagagaaccctagtccgacaggacagaagaatctagctcaagctaacccacatcacatgcagcatccacacatccttccacgtgggcagcatctaatgagggatccattaaaggaagacgtgggactaaaacagggcatacttctctatcatactgagaaaacaggactttgaaatcccaccaaaactcatgcgatctgcacatccttttcagctttgttattaagttcttagtaaacagcacagctaccattcattgagtacttcagcgccagttccttgagcgctaagggctccacacacattttctcatttcattccaaccacgactctgagagctgtcattcccattgtccagctgtggacgtcaagactcataaaggttactgatttgtccaggatcacctggttaataagcgacagaaccaaacttcaaatcagattaggctatctgactccagagcccaaaaaaaatttggtttgacttaattagcaggtatcaacccacattttgaagggacattttaaaacaccgcttaaataaattaaatttaaagatgcctataatccaggaattttccagaaataaatacttcatccaatatattcctttattcaaattataaagcagcatgttctgaccactgtctgtgccctccccttccaccgagccagtctccaacctccctttgctgtcacaggccccagggctgacctctacagatgggctcagcagggtgccttgcctcctggccacctgtcagggttggttgacgtggccccctctggagagcaggggtgagaggagaggggtatctcttcccctcaccttcccaccaccgacacctgccgcccaacctccctgggcgcttggttatggttctgactgcagctggattctagggggacctctcccgtcatggggcccctccttccaggctccagcctccagtacctggtccccagccagtctctggtgctctgcagatctcagccaagccatcagttcttttttggcactaaaaatgccttttttagtttacatttttagaagccatcacttgctttttatcacctgtagttttttgtttgttttctcctttacaatggctctttgcagtaacaaatgcaaaataaaaataaacaatatgattacagaacttgagacattttcgaaggctgtctttcaaatttgctactgagcgcattactgtagtgacaagtgaaagcattcacaggagtcctccccacattcacatctgtcctttctgacctctcacggtacaggcacacccattccaacccaattgcctctcatgaagagcatctacctccagatctgcatgctccacatctgtcttcagtctccctggaggcctcccaagattggcggagcttggctcaccaagaagatgacatgctgggaaccttaggcattttttttctataaccaaatttctaggtcttggaaaatatgtacttccccccacccccacccccaggcctaaagtccctctgggggatgagagttactgaaagtacagagggagtgaagtgcagtcctgaaattgaaccgggaagcagatgaaggtgaccaggctcctggtgctctcgtgggagaagaggctgggagaggatggggcctggctgaaggtttctgggagcataggaatcctcaactccccttatcctaagagcagcaggtgccacaggaaaacaccactctgctcctggggtcattcagcccggaaggggagcgtctgcaagccatcctcacaaagggagggcgtcccactgcacaaccctgctctggggagcacatggctatttccgtatgtctggacattctctctggactagttcactccgcacagttcctccctgcctgcacacacatgctgacgctcacaccagggactgaagctcgtccccctcccctcaaacccaggctgacctgtggctgcctctgacctgcagaacacagcagagggaaggtttcaggagtcccaggctcaggcctttatggaagtgggagcttccccttcctgcctcctgaaaccaagtccccataccctcagcagcacagcacatggcagaggaccgagtgcccagtggggcagccagcaccaacgccaggcccgggagggagttgtcctggacagtccagagaactgactctcagatgaccacggcccctgccgacatcagggaggcagcttccagctgagtccagtcagcccacagaatcatgaccaataataaatgggttgttgtactaagctgctaggatttggggtagtttattacacacacaggtcattgaaacaccctgtaagtgctctagaggcacggagaagatagagggtaaatagcttgtttcactgtcactatggataagtacaaagatggttccaacactcaactcctcctgtacccatgctttttgccacataactttgtgattcttcccattaaagaggtagaattacttcccaacccttatttttgggcggcctatatgatctgcttcagccaacaggcagtagcagaaagacaagtatgacagatcctagctgaagcctcaggaggcaggacatgttcccctttgcttttctgtaactttccaccagcatgggaacatggccagatgcatgcgggaggatgagaggtacctgaggcagagtcacccaccccaatcaccccaccaagactacgtttgatcatcccatagacaaccaaaaccccagacatgggagggaggcaaccagaccagccgctagccaagtccaaccagaatggccaacccacaggctcatggctgaataagtgcttactgcttgaagccactgaaatttggggaatttgttacacagcatttttgtgacaatagattactgacatacactttgcaatgtacaatcagattaccgagatcttcgttaaaatttttctagccagtgataaaaggagactcaaacagggcatttcaaaggaagccacttcatcccaacacagagacataatatttccactcacctacgagacatgatctcaaaccctaatcctgccctcaaaatgggtttggaaactgaaggataaccaagaaacctccaccagaagcctccatgggattcccagagcccttcccaggagcaactgaattctcacttcacatgatgccctgccagcctcccctggattccaaaaatcaaaacatccttggatatccaagaccgcagcaacatcatagaagttacagcagccactcggtctgtaaccaaccaagacataaactaaatgagcaactgtttgagtctcttgtttcttatggggaagttttgagtactcaggttgcatcaagtataaaatgacagggaagggaatagatagagattccagatgcaacacagtcctgatccttgagggatcgagatgggaaacagatctgtttcatacagatatgaagcggtcagtcctgagagcaggcagttagtggaggtgcccagtgaggcgtgtggatatacctagaggaaagagagagctgattcatgcagagacaagagggtgccaccaaggagccttgatgaacaagaagcatgaggactggaggaaagagggtgaaaggcatgaagcagggaacctaagtttctcccagctctgccacattagagaccaagggcgtatgagcttctcacaccgccaccaccagagtgatcacacaccaaagggattcactcagcacgcagcgtgatggcactgccaccctccacaccagctcagcgaaaacccaacggacctaaagaccaggagaataaaagctcaaccaccctcccctgcctcctcaacccacacggatctctgactctttttttttttttgagacggagtctctctctgttgcccaggctggagtgcagtggtacgatctcggctcactgcaacctctgcctcccgggttcacaccattctcctgcctcagcctcccaagtagctgggactacagccgcccaccaccacgcctggctaattttttgtatttttagtagagacgggatttcaccgtgttagccaggatggtatcgatctcctgacctcttgatccacccgcctcggcctcccaaagcactgggattacaggcgtgagccaccacgcccggctaattttttgtatttttagtagagacggggtttcaccgtgtcggccagatggtctcgatctcctgacctcgtgatccacccacgttggcctcccaaagtgctgggattacaggcgtgagccaccacacctggccctctctgactctttttgcagccatttgagtgcctgttcttttttaccatttcagaggtattttatggattttttaaagagtacttctaatttacttttgtgttcctaatggtcatttctcaaatatgtagtagttggtaaccaaacaaactaaaaccatactaaaaatttttagtagttggtgatagtttcatgtcactgtaggaacctttttattttctattttacctgcctttgaacccttgcagaacttcactctatgttgattgaaaatcatttctttaatacttgtttcttgcaataaactcatttgctaaggtatatacttccatatgattttgtgtttcatgacccagctatattttattattgggtatcttaaagaaacaaaaaaggccttaacaataacagaattctacttgtgtcacttctttgtttttgttttcaaaatgccaatgtcttactaaatagaaacaaacttgatttgaattacgtaagctctaaccacataaaaaagatggactggtacccaaggtagaagggaaaataagcattttgtaattatggaggcagtattgcaaaatggttaagagaaggcctaaatatttgcagggctggtgcaagaaaatagatggaagtttgagacccctcgaccctacccctcctctcttctcaaacccaattgtgttctgcgggttaggggatgcatatagtcacgtggacatcccgatccacatggccacactccattcagcaatgctccctgctcatctttcagacccagggaaacacacacaagatcttcccaagaagatgaactccaggaaacaggctggtgcagcccaaaagatgctcagtcaagtttggaaaggcactctgggtgccccagcacctggggcatgtcctggaatggggatgggttcagctggggagggcaggaatggggcctagaaggcataggcaggacgctgggctgggggcagtgctcgatatgagcacagtgcagagccagatgagggatggaaatcagatctgccacttactccttggaaacctataaatgatcactttatcctccaagagccttagttacacatttgcacaatgaggataatattactgtagtataataagaactccatttgcccttgtctctcgtttctggcatggagctcctaaaactctgggaatttcccaagtgatgggagcatcttttgttctaagaaggcagcaggttggtgagtccctagatagcttcaggatgggggctaattgcaagaaagagtgagtcttgattagatgctcagaaccttcagccccatttcccaacctctcaggagaggagaggagctagaaattgagttgatccccagtggccagtgatttaatcaatcctgcctatgtaacaaaatctccataaaataccctgacggggttaggacagcttctgggctggtgagcatattggtatgaagagtgtggtgcaacccaatgctaaagggacagaggcggccaggcgcggtggctcacgcctgtaatcccagcaccttgggaggccgaggagggtggatcacgaggtcaggagatcgagaccatcctggttaacacggtgaaaccccatctctactgaaaatacaaaagattagccgggcgtggtggtggacgcctgtagtcccagctgctcaggaggctgaggcaggagaatggcgtgaacccgggaggaggaggttgcagtgagccgagatcgtgccactgcactccagcctgggcaacagagcgagactccatctcacaaaaaaaaaaaaaaaaaaaaaagggcagaggctcctgtacttggaatccttccagaccttgccctgtgcacctcttcatctggttgttcattcatatgcttaataataaactgtaatcataagagcatagcgttttcctgagttctagcaagttgttgcacctaaaaggggggttgtgggaacccccaatgttgtagccatgtcagacagagtgtaggtaacctggggacccaatacttgtaactggcatctgaagtgaggacggtgttggggagctcagcccttaaacccatgtgctaacttccggtagtcagtgtcagaactgaattgaactgttggacacccagttggtatcagtgttgaatgactggttggtactggcgaagacatgatgtatttggtgttgggaaacatgaataaaaaatttgtaaaacctccaaacgatgttcagcaattcacaaaggtgtcagtgcaagagttggcctgtatctattctaactggtcagtatgcaagttgaaccattgtttgattatctcctctgtctacaccatcaggcttttgtgaggattaaactaaattatgcctcagaaagaaaactctctcaaggctaggcacataatcaacactaaacaagtggtaatcattataattaagaaagtaaaaatatttcaaatggacgattttgatactgtataaaatgttgcaacttttttttttttgagacggagtcttgctctgtcgcccaggctggagcgcagtggcgcaatcttggctcactgcaacctccacctcccgggttccactgattctcctgcctcagcctcccgagcagctgggattacaggcacgtgctaccatggctggctaattaaaatgttgcaactttttaggaaaaataatcctcaataaataaattgctaattttcataagagccctttgtcaactgactaaaaacatccttaatttagaaatgtattttttagttttaagataactagtcattaagtgaaaacattgtaggcaaaatggctctaagcaatttagtattcataggaatgaatccattccttgaaagcattggtcgctgggtgcacttgtcctggatgagcagatattaggcaaatcagtctttcaccagcaaaccctgccataagaactgcacaggcctgattcctgccaagcacaccaggcccctgactggggcagaggcctcccttatggggcaggaagaaggaggcagggagaaacatagggcccatgatttaaggaggctctccctctcaggctcatgcaagtgcaggatcagtacctaaaggggagcaccgcccgaaatcctgtgccccagtcaccttaacccagtccagccctggctcctgcactccaaagctaagcagggaataccagcgggagacagaagacagcatgagaaactgaatgcatctcccacatttatctaaaaataagaaaatggacttcttcagtaggaaatggctcatctttccaaatgaataaaaatacttatagctatgggttgaattgtatcaattctctcccccagttcatgcactggagtactaacccccggtccctcgggatgtgatgatagagaggtagggcctttacagaggcaatcaaattaaagtgaggtcattagtgacctaacccaatgtgactgatccacttacaaaaaaagggacaagatttaaagacagacctgtatagaaggacgatggtgtgaagacacagggaaaagacaaaagaggcctggaacagattttcctcaaagccctcagagggaaccacttgggctgacaccttgatcttggacatccagcctccggaacggtgagatgatgaatttctgttgttttaagctacccagttcatggcagtttgttacaacagcactgggaaaggaaatcacctctatggagggacttacgaaagtcacttaactaatgcagattagaggcctcacagtcagggcatggcctcaagagccacatccattttaattgtaccatttctcactgaactctgaccctggtcaaggcatgtctcaggctccatggactactattccttccactgatcgaccctggcttcattctggcaagggagggactcatacattctgcggcctgcatgagtgtcatgtgagcacccccataaccttgatccctgcggtgcttctccaggggagccctagcattccagctggcctcatgggcatgccttagagagagggagctgaccctctccttcttcaactggattttatttttattttttggcatgttttgtgaatacaaagattcactgcctgggtgtgccccttgaaagaaggtttcaattgcattcaggtgaaataaccacaaaatgactgtaagccaaatgtagtagtatgatagaaaaatggaaatatcgtaaaagcaccagtctgtagacacctagcttctggttcctctggaaaagggagaagagagtagacagtgatggagaaaagaggggctgtgaagactatagaactgagaaggcagtaattctaaaatctccacactgtagggccaggaacaggcagtgctgggcaatggggcatcttatctcagggaagtcaagggtgtcatgtagaaccaacataattcatccaagtacagcaaagaatccagaaatggtctgtggaggtttggaaccatgaaaatcaaataggaaagatacaaaatatttacatatccacattttttaaaaggggtcctgactaggcagcataagattatttgggttctgttcattttacctttagttgcccttggttctgccatcttttttctctgtgagtcatttgtcttgcttttggtcaacacggctttcctcgggtctccaaagatcctggaataacctgaatataagttgaagaatattaaaccttattttgttttcaaatattaataccagggatcaactgtacatgtaccgacaaaacctatttcttaaacattattttaaaatatcctaaaaggggaaagaacttaaatccttccccttaaaaaaagaggggacaacattcctctcctctgagggaagcccagcattatgaagcaaaaatcgggagtgaaagcaaggccaagcctaactggcatgctgaagcacacagatgcttttgcacagaaaatattttgaaaatgttttcttttccttatagcccccagctttggtaataatggcttccctagatcattctgttagcactttctgctgctcagaacagggtagtgggatttagaatttagaaaacatcccgagaactgtaattaagcaattgtcatagtcccagaaaagaaacaacccttttactttgtaaatgctaggaggatctgtattttttaaaatcttagaacactaactagctaaaaagatagaaagaaaaaaatctttcttacaatatgcctgtagcacggctccaaaatccagtccctctctctcttcttttttttttttttttttttttttttagatacaggaatttcttacacaactttccaagtaaaatattcaatccccaaataatatatttagtagaatccttacaacatgagaaattgtaaatggcatctgtttccgttgaaaatatttttaaattagaaaacatcttaagcactgcatcaaatcaatatttgtaatgggcagaattatttctaaatggttccacaggccagttgacattcccactctacttaggaagcccccagccaactccacctgaagtcttcgaaacctatgcatagaggcaaattgcccagatgtcacagaaaagcatttgttgtgatacagaaaataaaacacattactgggggaaaaaaatcagggtactaaaccacgtacataatatcatcccaatattgcacaaagaaaaaaaaataagtggatgaaataaaagagggaaggcaggaaaggaaagaggatgacctgagaaaagttatcaaaatggttaacagtcatggtctttggctttccagtgtgaaataggagttcttattttcctctttttaaaatatttttaaaattatttattttttaaaccaactaataaaagtaatatatatttaccgtgtacaacattatgttttgaaatatatatatatatatatatatatatatatatatatatatatatatatatatatatatacatgttggaatggctaaagtaagctaattaacatctgcattacctcacatacttatttttttgtggtgcgaacacttgaaatctactcttagtgattttcaagaatataatgcattgttattaactacagtcaatagatcataggtctattcaagttcaagtcacagatctcttgaaattactcctcctgtctaactgaaattttgtgtcctttgaccaacatctccccagttcccctacgctcaacatcactaatcatcaaggaaatgcaaatcgaaatcatgatgagtgtcatctcacacctgttagaatggccattatcaaaaagacaagtgttggtggggatgtggaaaaagggaactcttgcccaccgttggtgggaacgtagatcagtacagtcattatggaaaacaggatggaggttcctcaaaaacacaaagatcaattacaaaacaaaatactatatgttttacaaatgtactacaactcaatttggtatgtattacaaatcaaaatactacatgattgctggcaatcccactctggagatagatccaaagaaaatggaaaatgaaatcggtatgtcaaagaggtaccagccctcccaaattcattacagcattattcacaacagacaaggtatggcatcaacctaagtgtccatcaacataaacgcccataaagaaaagtggtgcacatacacaatggaacactattcagcatttagaagagaaatcctgtcatttgtgacaacatgaacaaacctggagaactttatgctaaatgaaataagccaggcacagaaagacacatactgcatcctctcacttatacatagcatctgaaaagttgaactcctatttccttctttatagttttgtgtattttccaaattttctaaaccaaaaatattcatctttataatcaggggagaaaactaaggaataatcattttataatcctaaacatgcttttaaagcatttatttcactgtaatgtattcttttcccatccagtcatacatgggcccaaggagctggccttccctgctcggcagcctgatgttcaaggggatgggggagggggacggtgcagtagatcatgctttgcaaagctgtgcaaatcttttttttttttttttgagacggagtctcgctctgtcgcccaggctggagtgcagtggcacgatcttggctcactgcaacctccgcctcccaggttcacaccattctcctgcctcagcctcccgagtagctgggattacaggcgcccgccaccacacccggctaatttttgtattttagtagagacggggtttcatcgtgttagccaggacggtctcaatctcctgacctcgtgatccacccgcctcggccaaagtgctgggattacaggcgtgagccacggcgcccggccaaagctgtgcaaatcttgagttaataaacatgttccccaaatccaaaagccaatattgactattgcttggttaactgttttgcatggataagtggttaaaggagtatttggtttccaatttctgcaaagggaataaaagttttaaaagcgtgaactaagatttcctatactatgctattctatagtaggtttttatgccaaaacctctactaggctgaaaggataatttgatttatggttgagacattgttgggcctgatttaaagcccagagtcaagcccagagaggattctcttaaatatgtgcaatgggtatttttaaattagcattatggcgttattaatatttcatttatcctgagagcatttacctgacaacgtaaattatgtgtaacacagctgagaagccacaaaggatccaaaaagatgtcacgaagtccacgaagagaagctttgccagagaaaggcacactaccagccgcgtgagctggcctcatcaaagcaaaaaagtcagaaaattatgtaaaccagactcaagaactcaaaaatacagtcgtttgagaacattggtaagagtgcaaactgctcaccccagctcaatcacccctggtccagcaacggcagaaagccaaggtcaaggagtcacatgacctgaagagacaccccccaccaccaccaccaccctccaagccctgcccctggccagtgggacaaaccacatgacccctgggattcagtattcagtcaggttctgtgttctgtatggggaggtagaagaaggcaccagatcatcaggaaatctggactggaaatggccaaagctgaacacatctgagtacctgaagggtaagcttaaggtgtcaaagcagccatggtgaggcagaaagaaccttgagcttggggccccaagtttatgctgacccactagcagccaacaaaacctccctcagcctcagtttgctcatctgaaaactgtgagtaagaggctctgactccagagaggtggtgcaagttcaatgagaaggggttgctgatggtccagatggacagatgcaaagcactgctttctgtttttgtctttgttttgatacaggattctctctgtcatccaggctggtgtgcagtggtgtcaatagctcactgcagcctggaccctccctggctcaagtgatcctcccacctcagccacccaactagctcagactataggaaaaagagtcatgcaccaccatgcctggctaatttttaaaaaaaaaattttggagacatgagatctcactattttgtccaggccaatctcgaactcctggcctcaagcaatcctcctctctcagcctcccaaagtgcttggattagaggggtgagctaccatgcccagcaaaggcattgttaaattcaggaatgaatgaccaccttgttccccaaaacactagacaagagaaccattctctacgcacagatctccctggccaccacgtgtaagcagcagtgaatattccataggtggaactggctactgtgaagaaagaaaactccagaaaagctaccctcactccaagaagtagcctggaccccacgtgcgtgacagcagcctggggagaaggctccactcccaccagcaatgccaaggacagagcagcagcagccgtccatccccacagttatggtgaacacagccacagagcagcctgctttttccatgtatagccacacacaggtggcaatggcagcagacgtaactggctgcccttcctcccttatggaaggaaacataattttgcttgggtgttctgcctgcccccacatgacccacggaggatgaccagccccaacaccagtgtaaatcctatcactgggcaccatctcttctcaccacggattggtttagggaagggcacatgatataattctggtcagtctaacactcggggaagcgagctagaggacttctaggaaaagtgttggctgatgaagaaaggccatagagtagtagtcctgtctgtgtggcacttggaactgtgagagccatcccaggaccatgagaagaggtcacctgaggataaaaccaatgtgctgtggatatctgggggaaaggagggaagtccttgtgtttctacctatggtagggaagagtataaaccaactctgaaggcatctcatggcagggcagctaggcacatcaaatgcattttccttgttaactaaaccattttgaattggggtcatttttgttgttattgttattactggcagcaaaagtatcccatacactctagtagccatgttcaaaaaagtcgctttcagctcttttaccatctgtatccatagtcacgcagacacgctgagtatgctcttcagttctaattttaaaataaaatgatctgctggaaattagctcagctcatagatctccatacttacaacaccgtatctaagaattagtaaataactattaccatgataagtggcctatctcagtctatccacatgttgagtgtccaggtactggaggtggcatggaacctcccctcaataaacaaaggctatgatgagaggttatactttaaattaaattactgagtggaggcataatgtggtgagggtcacaagagaggtaccaaagatgcagcaacagagcagttgatgggcacttagcatttcagtaagtgggaatggggaggagagcaggaaaggtggaggaaatagatgaggagaggaaagaagggaagtgttctccaaggaagcacgctgcagggaaagagtctttcacctgtatgtcccacaaggcacagagtatgaactcagaaatgttgaatgatttgtctctataattaagggatgatttcactgataatgttgtcttcttccatgatctaaattcaacctgcccttcaaatccattcattcatacaattgttcatccatccatccatccatccatccatccatccatgtattcatgtattcattcatctatccatccatgtattcatccatccatcatccatgtattcatccatccatccacccatccatccatgtattcatccatccatctatccatccatccatacgcactgagttccctccatgtgccaagcactgagctaaacactaactagggttgggctttgccaatgagttcagagcctagtgagagagacagagttgtaaagaaaaaaatcacaaatgccaactcccccattgccttgcttgatccttaatgccagagtgtagcttggttgagcatgacaatcagctggagagctttttaaaaacagaaattctgcaatccttcctcttttttctttattggaaagtccaggggtgaaaggggcaaaagagtctaagtgggagttagggaggcagaagaggattgaaggcagtgtctgaaatattttcagactgagaaggaaaaggaaaacagccaagaacacaaggaggagcagtcagagcataaggaggaaactaggaaagatctaagtcatggaagccaaggaaggacattcagtaagatggaaagttcagtgtcgcaactgcagagagattcatgtccaggagaaagtcattcaaccaaccatacgcattgagaacaggtcctggatttggcaacttaaaacctcttgctgtcctctaaaaatgttgtaggagcctgacagcattaagccaaatggctcagtagttaaaaacagggaggatatgcaaagggcaatgtaggctactcatagaagaagttgagcaacaaagttagggagggagtggcagttcaaagaaaagcactaatgccacagggtgcagtggctcatgcatgtaatcccagcactttaagtcaggagttcaagaccagcctggccaacatggtgaaaccttatctctactaaaaatacaaaaattagccgggcatggtggtggacacctgcaatcccagctactcagaaggctgaggcaagagaatcacttgaatccaggaggcagaggttgcagcaagctgagattgcaccactgcactccagcctgggggacagagtgagactcctcaaaacaaaccaaccaacaaacaaacaaaaccaaaaaaacaatgaaaacaaaaatgaaaagcactaactggcttcacccacccaacatttgctgggcacttactgtacttcagaaattactagtagctagggatgcactagtgcacaagactcagccctgccctcaaggcatttacaaaccaatgaaaagaaggtttatcttatttgctcagtctgtttgaaggatgagaaaagcaggtatgtttatagacaggataaagggagccagtggagtagaggagatagagattctagagccagggcacttaaggacgttactgtctggggaagaggtagaggaaatgccatgtttcacagcacaatggtggggtcagttctggcaggaaggtgggaccccactgtctcagaaggggtgtgctgccagatggctaacaacaggctctcacaggaaaactcctgatttgaagcacttggtcatttctatggagtcaatatttccatcatgggcaactgcaaggaacccaggggagtccctgaatgcagagttgggaaaagatgtgctctaacgcatcattgccggctctagcgagttgggaggagccagctctagcacacatgggctccagaagccaaagagagaccaagaagcctggaactgttgataagaaaagagtgttcagaggaaagctgtgaagccagcatagccagctgctctcctaggcgctgagaccctgtgatgagaggagaaaccagggaggcggagttccaaatctggaaaagtggcaggcttgagtgctcttcagttactcccacttgagcaattttgctttctaaacctggttaatagcccaaaatgtgggctgcttattgtcatctcccttcactgtgtgtgtgtgtgtgtgtgtgtgtgtgtgtgtgtgcttttcctatgtaaactgctgcaccactaactctgctatactttagaactcagtaaggcaatccttagactcttatacaattccctaaagggtccccttttactctaagtcacagagaaatgttgaacatttaaacctttaaagtgcagttttgctggaagaaaatttcaagggtctccatgaatcatgtctgagccatgtattggccatgaccgcatacttcttgtcagtcttatttcatttggttgttattgtggtttggtttcatttcatgttgctttggagggtcaacctttctttcattcatgacattcaatcaacctttctccccagtgcgtcttcccattttttatgtgtgtgtcaggagatagaaaaataaacacaggtattaatgtgcctgtgggcaccagtttgtaaagcccaagacgttcttggacccaaggaaactttcagttctttctcagccttgccgttttgcatgtaaagcatttgagctgatctcagagttgaggtggctgccagcttccaccagaacaaaacacacagcagcaaaacagcgccatgtccctcagtgtgggaaccagggtctgcctggggcccccctgtaaaaacgagagatctgaaggaaaacagacagcatttgaaaggcggatgacatcaagaaagtaaaagcaactataaatatgacttctctcctgctttacactgagccttctgttcaagaaaacacatttaccagggattttttccttaagctcaactggaaaaacaaatatttagtcattttacaagagcagacaactgaaaagcaagccacagattaaacaagcattatgtatttctaagaaagttcatcaaacacaatatatctttgagaacacaatcttgaagtctgttttagaggcaaatttgaccttcaaaatgaattttgtctcgatataattacaaggtcaaatcttaaagaagcaaatgcatagacaaccatctttgcaatgagatctgttttatatttgcaaatgaacaatactggacagaaaaaaaatacataattacttctgaggttatatataaaatacccaattggcaattagctaatatcatattagcatctcaatattttagataaagcaaaactcccaagtacaaaataatctataatagaacaaaaatggcaagtcatattaaagagagattacatataagagactttattacaagttatcattttttagataaaatttattctttcagcatcactttgatacttgtaggaggcagatatagtatagagaggcagatagaggtgagaacctttcctaagaaaaatcaagcagcattaaaagcataaagaaaaaagaagaaaaaatatttcagattcccaattcgtatatcacattgttgacaaaaaaaaaattagagaataccaacaggaaaaggtttccttgtgctctttaagggtggggaatttcaaagaaccttgaactcatcatgaaaatagttctatacccatcggctttgccaaaaacactttgggatttcagtgatgggtactgagccaccaggagcaatgaaaccagcttttccatttccactgagttttgactggtttacaaggattgcacaaagatcacctcatttgtactggacacaattgggaaataaaaatttaaaaatcatccttcatatttaaaatagaaatcatgaaccccgccacaaacatgcttccccgacactcaggacctgaggttgacaacatgcctccccgttaacccatgaagcctcataggtatgcactgcatctatatagaattttccatggactccatcatcaaagcatcctttaacaagtatgaactgagcactcaccccatgcacagagctgtggacggggccatatgggacagaaaagttgcaaggtgtgtctctcactcccaaagagcccacatgccttgcaggagaggaaggctgtggacccaggttttgtgatgcagatgaaggggccacatagctgctccagtaagaagaactggaatcatctgaaggagaggaaaatagggcatttcagccttgaatagcagaacccagatcatgaaaaataggaagaacttatatggacgtcagagaggaaggcaatccagacaacaataataacttaggcaaaacagaaatcaaatgcagcttgcagaagactctgtacagggagccaacacagctactttacgtgaggagtcaatgagaccatttaatagaagccccctgtcgaaactgtaaaaatgattttgccatcttggccatctcctgagatggctgagaagggatttgccaagcaaaaaaagagttgaggggttttgcacaatggcctggaacagagaggctggagagaaatcagacaagtctctcaggcagaagttccagaaaaatgaagaagcaggagagcccgaggcaagagggaaatggcaggcacattggttggacgatgagggtttgtgtggatctcaaagggccaagacgtggggagagtctagacttttaggctaggaagtccgaaccttgttgtgaaaatagctgaagattttggagcacctgccgagcaaagtttcccaaagaggctgttgggaagattcatgaggcaggagactacagggagggaaggccagaggcagagaggccagttccaggatggctgccacgatccagcccaaggtaatgaaggtggggaagcctcggaatgcaagagacagggtggagatgagaagacatgtcagagcctggtggccaattaagcagagaaggtgcagggaagagaggagagcaggatggaaagccaggaaatgtgggtctcagtgaagatggggagttctgtttcagccccaagaatgagcatgtgcatccttgaaccccggggcctgtgaggttggtcaatggaagcccgggagctctgctcagtcagggtctaggactggtactcctgctggggccacctcagagcagaagcagggcgggagcggtggaggctggctctgaagtgttctgcccttaaagaacagcaagactttccagaggcagtgtgtagcctttaagatggagactgtgatgaagaatggagagagatggaaagagcttctcagtgacatggggagagggtccgcacctggagggcaaacccttcctggagggcagaacctcgctggccatctggcttcccacacacctgcctggtgaaccaacatatcactagggggttcttttcttgcttgaaatgtcattgagttttcaatttgtagcattcatgaggtgcattatgaggtttattcagcattttttttcttttgctgagaaaggcacaattaagtaccagaattttctttgctggcctagccttctggaatctgaacaggttttgcaatcccaggaccagatcctctctatataaaaattggtgtgggattggggggggggggtctctttttataatagctagaacatcttaatattttgtaaaaaataagctcatcacgaacccagttaacccagcaaggctactgcccttcttctgtgtcgtggtaacagctttcttcagcagtgcaaggtgcaggcagagcctttcatagttttaatcactaggtccatttattgagagagcttgaaaggtgattattcctgttctcatttctcagaaaactgaggcatgtgaagatcacaggtagggtaagcaaatgaacacaaattcaaactcggaattcaaaaccagcctctgtgtattcctgaggaccatactgtctgctaagtgtagagaaaggcacatcctggttcaacagcagagaaagcaaacaggaggcactttctgtgagtcatctccaccacagggccctctcttttgtgatccagcgatacttgttcacagtcaaagcccaggaagagtggaaagattaacctttgtgagccaaaccgtgtgacacttgattacttgacagaactaatccttctgtcctgatgacagaaattcaactacacaggtacatgcaagctaatatctgttgtaatgcctcccagtttctctggagaattccttagtttcctggacatctctgaaatgcaaagttttggcaacgagtctctgaattaacctctgaaaatctcacccagccaagatggccttcttgagaagactgaagaacatggttggtttcaggctgagctggaagtggtttacctcccaggagaggttccccacagtggtgtttaaggcatggggtggaccaacaccaggaagactcagacatcacaccacccaccttcaactcagtcacatccacctacattttctgaaaacaaaaggcagtctccccaaaaagcactgagactcttgtgtaggtaatctgagcagacaccaacttcccagggcttccttttatccaggagagcttggctgttctttttaatggtaatatcttcttcttcctgcagcaccgggctgtggcccactctggagaaaaggaaagatcattgctggcctgccttcccaatttcagacttgccagtctacaattgtgtaaactaattccttaaaatacatctcattatatctatcatccatctgaatctagatgcatacatatgtatatacacatatgtacacagttataaatatggatcaatataatgagatgtatttttaagaaattggtttatctgtctatatatatttacatacatatacatccatacatagatatctcattttatctctatatctatatacatataaacacacgtgtgtgtacatttatgtatggacataaagatgggtgtaataagatttattttaaggaacttgaaatatagagagatatctatatatatctacacacacacacacacacacacacacacgcacacagagaaagagagagagggagaaagatctatctacatccatcctgttggatctttctggagcaccctggctgacactcctgcattgatgagtcattggttgtaggatgtcctgggaacgaggcatgagcttggacagggctgtcatcatcagcaggcacttcccaaagagggctgacagctgaggcatcttccaaccatactcccagcatctgagggaataagtccttccttcctgaagggaacccagacagcacatcacagagcccacaccaactgggcaaattgaatgtgcacagagtaaattaccaaaactgccaataaaactcagaattataaaatcatataatttagaaattataaaatcatataatttagaaattacgtgatgtaattaacatttgcaatccgttgacttaaagtcgattatgtgggaaataactgagagttcgttaataagcacaaaacaatccagcagaaattgacagcattaggtgctcaggttgtgtggaggtcaatctcagcaaaccagagtcactgggctccctagatggagttaaggaaagccctgatcttggaccagccacgtcctttacacatagcaaggactgtaagcccgaccttgctctagcacaggaaggaggagggcttccctctaaaaaccacccattttctcccagaaccccaagactccagtccctgtcaggctgcagaggtgatttccaaccatctgatgccacctgcatcagaatcgctgaggcattcctgggccccatgccccattcctggagtcagcagccggactatgagactggctcagtgaaccccacagacagggtcacaggcatggaagcgcaggcagcagagtgcaggcacagaggctagcagtgaccatccacctggccctgaacaagtccaccttctcagagttttagtttcctaacctggaaaacagggaataatatcatgaaagaaacaccaggcacagcactaatgtatcacaaatgccacataagtaactgagtgcaaaatgggacatttcctgccatcggctgaggctcagaatagcacacagagcacagcagcggtgcactctctaaaaaaggatgcccgcacatccatgcacaactctctaaggagtgacctaaataacaacagcaagtccctgcccctctgccttcccggcctcaagggtatatatgtcagaaactggtcaatgctgagtatacagctcccacagtcgcagaggggagcagggtggatgtgtagagttttctggtttctgcacagtataaatcctcccacaatttcaatcaaccaaaggaggagttgggagacatctgcacaattagctcttgtgcaccggcactgatagaagagaccagagacctggcattccttcagagaaagtttcagaggctgtgcagcacctctctccaccccagggaaagaaaggaaagggggacataggcagggaaatttcacatccatgtgcagatgcaccaacctcaaggccagtgagggaagcttcaaaaaaaccatttaggctgcctccaagggttcccctagggttctgagctaccagggcacaggggctagtgactgccttccaggtagagaagtttgcagaggctgcctggggacaggtaagaaggagaggccatgggggggcacactgagcttccatccatggtgaggtgagagggcctgggtatatccttgtacccagggacccatggcaggtggctggacttgcaggggtgagccagccctgacagaaagaggctggaggtgtaccagggtgaagctaggggaagggtaccatcagcagacacacacagggatgtcaccctgccatggagagctgtggggcaatgtcactgcaagagcccttccgcaccctcccatgcattccatgaacaaggggcagcttttagacctttgcttcacagaggggaatccgacaccaaattatgatgcatggccaagtaaccccattaatagcccttgttgtcctgtcttcctgctccaaccctggagaaccagaggcagaggtcagtggtaaggagaggagtgggtgtgcaagcctctgaggctgggagccggccatggccccagaggcgtttccgatgctaacaccagctccggatgcaaagaatcttgaaacaggacgaacaataggcttttaaaaattcaacttccctggacctctcaatacttggaaattagactgttcactgtatctagaagtgacagggaaagtctggtgcctgaggagactcggaacagggacaggaaggagctatcagacttgaggcatgagtttggaggaagtaaagttgcacctacatcataacctactgagaacagctcattcagaaaacaaagaagcccagtttctcatatgttgggtgggtggccctgccaggtaaacctgtagcaaagccacatggaaataggatagtgtcaaaaccaatcaggccaagagtgagcaacagcccactgggtctctgaaagagctgaggaaacaagaggaggcaaaagaagtgatctataaggcacgaggttggtgacagggccaggaagtttacaagagcgagcatatcagatagacaaacaccaagaggcagaagagtctacagatacaaggagatccaaacctacccgcaatccccacccaaccccgccccggctttggctaccctggggctggcgaaggtattaagtgaaaacacccaggtttgagaatggctgggcatcaaggcagttttgacaacctcagaatcaggaagtatttgcctgcaggccagtagctgggagaaatgtccagctctacgtagatttctgtagctggggtcccattttccttcaaggtgggatgggtaagacagaaaacgtcccctgaaggacaagactcaggacagctccagcctagtgtctcccggtccctgtttgctccacaggagaaagaccctccagagtgcaatgaaggggcccagaggggacagtaaagggaccccatcccatgtggcgactcccatcatggcagaactgtagaatccaacatcacatggacctcattgataacactgaccacacctccttgctcttaagatggataaagggcagggacaaggggctccgttttatttgaccaatagctgcaaaagtaagaaatcgtaataagcatggaatcacagaaccagttgaatgtagaattaaacaattaaggcacatttctggcttaaagatgccaagaggtttttgtttgtattctttatgttttttttggacaaccactaaacacacattcagagcatcttctataagagccacagagacatcccttgagacttcagatgatttcaaaactctgctatcgctccttgaaaaaggcaagcctgggattgcaacctatccatgcatctaaccccccctggaaatctctggctccaagagtctaatggtgatggctgccactattagatttcctttctctctgggcattacaatcaggtttacaaggaagaaacaccacccagggttatcacctccaccagtggacacagagttcaccagcttttattgccgggactgacagatgtcaaggggatcactggattccaggattgacaggatggaacggtcagtaggacgccttcccccaacaactcagatgacagagtccacaacgcggcagccagatcaggcaggaatcccacctaatgtctgaataacaccactgataggaatccccactgaatcccaactgaaggctcagttgtacactgtgggcccaaaatacctacaacgttttacaaaacctaaagaaaaggcagatctctttggtggcaaaggcaatgtggtgagttaactttgaagcaatccaacaccatattattgtcatagacatgctcactaagaaaaaaaaaatcatacagagaaatagaaaaatagagagataaatgaataaatatttattttgaggtttcactgccaaaggctagccagagaaacaggggagatacaaggtgaagattggaatcacaactaaatattgttcctgtataaggagaattttccctgtttgaattcttagattacttgactccccgagtttctcattcctttgacaggcacccatgagtgttacactccaagcactcaccctcctatttccatgtgccagcatttccagtcactatcttgatttaagtagagaggataacagttttctcctacatagtaactttaaaatagtaacagttttctcctagaagcaacttaaaataaatttattgacattaaaaaattttaaatgaggtgtagtcaaagcttaaccagcacttttttaaaggagcatattttactttatttttatttttatttttattttgagatggtgtctccctctgttgcccaggctggagtgcagtggtgtgatctcagctcactgcaacctccacctcccagattcaagcaatccttaaagaagcatatttcataaagaacacttctgagtcacttctgttgtcttcctgagtgctttttacctgctctttgcatgtggcataaactcctgcttctctaatgcatctcagtttttaacttttggctctttcactgcaaacataggaatttttaaaataaagaaaccacagccaggcatggtggctcacgcctgtaatcccagcactttgggaggctgtggcaggtggatcacgaggtcagcagatcaagatcatcctggctaacatggtgaaaccccgtctctactaaaaatacaaaaaaattagctgggcatggcgatgggtgcctgtagtcccagctactaaggaggctgagacagaagaatcccttgaacctgggaggcagaggttgcagtgagccaagattgtgccactgcactccagcctgggtgacagagcgggactctgtctcaaaaataaataaatacataaataaataagtaaaccaaaacagttgtacaaacaccagatattcaaacatcaaatgacttgataaatgtggactttaacggggcaggggataaggaagggaaatgcagcaactggtgcatttacagcaattaatcctccctcatcattaaaaaacactgctccattttgtaaatagcagcacagagcaaccacactggagaagtcatgcttaacaatacattcatttgtgggctttgtgatttttttccctctcaagccattttgaagaaaatctttgaacacgtctcagtggcttgatgcttcacattaagctcctttaagcagctagaagtttcctgaaggaaacacatgagccttttactcctagaacgccaagagctggtggagtcctcaagaaaaaaacgacgattccagtgggaatgaatttccttctgagaagtgaagggcaaaccacattgaaaaagttgagcttcatgcctcaactcagaaagttaacctagccagggtccaggcaagaacaaaatctgccagaaaggcagggtgagctcagacagatttcaagcaggagcacaggcaaggtaatgttcaaaatcctgtccagcccccaggtactatgaatactcaatgacatcaaatggagccagttccaaattgctaaacttgtagctcatagctgggtctcctcaagaacttgtctttagacccctaaagacacctctgccacatgaagagacccgaaacgcagcttacatccagagcaagtcctttgttaatgaaaatgtgaatggcaaagacatcaaggtctctagcagtggccatatttgaacatgttttaggactttcagataaaatccgattaaaacaaacagattggggccaggcacggtggctcacgcctgtaatcccagcattttgggaggccgaggtgggcagatcacaaggtcaagagatcgagaccatcctggtcaacatggtgaaaccctgtctctactaaaaatacaaaaattagctaggcgtggtggtgcgcaccctgtagtcattctttgcagttccttgctctggggctgcatgaaggacttccacctgtgaaaagaagtggcgaatctggggcccatcattggaaatgccagccttctcactgagtctgctattttgcaagaaaaatcaccaacagcattccccttaagtaagtctctcgagatatcacccaaggcagggaatccccaactttgctcttggatcaagaagggcccccgataaggttttcaatcatccttagaaaaataggaggaaagcggaagaacagtactcttaggcgaaattaacataactgaagtcacattcttttgaaactatgtcctcagatttttgggggtggaggttaaagtgtcctttatttgctgaaatgctgatgaaattagagaatagaggttttcctcctttgttaatgccttcacgtattggcatcttgatttcctccttttaaaaaatgtactagttttggccgggcgcggtggctcacgcctgtaatcccagcccttcagggggccgaggcgggcggatcatgaggtcaggagttcgagaccatcctggctaacacggtgaaaccccgtctctactaaaaataaaaaaaaaaaaattagctgggcatggtagcgggcgcctgtggttcccagctattcgggaggctgaggcaggagaatggcgtgaacccgggaggcggagcttgcagtgagccgagatcgcaccactgcactccagcctgggcgacagagcgagactccgtcaaaaaaaaaaaaaaaaaagtactagttttatgtcttaatagcaaatctccattctaaaatgtctacaaaattatgagaattttattatatacatgaaaacatctattatggaataaataggagaaaatgtaaaatattatgtacagtatgattacaataagaaaaaataatacacaaatgtaaaatgaagatagttacacaagggtggtataattgaggcaattttgagtttttaaataattgtttaatgtccttaaagcattactttttaattaaaagaaatttcatgtgaatgttattataacagatttataatagactttttaaattacctaccaaagcataaacatttatctctacagatattacagtatgcctttccaaaaatagtcaaataaatgttagctcttctattaccagtataatgtgtacattgttagtattactgattgtgtcctgtctaagtacgaactcaactggcatatccacattaggtcctgaagaatggcctcagccttactcaaggaccgttctctgataatgtcagcttgaatagaagcaacttaaaaatctccatgcaatttctattagcctcactcatgctgctgcaagatctacaagccatttgctcttgttgggagtgtgaaatgttaaccagaaagtgtacttattatagggcgtattatttcttttcttgcttgcttctttctaactgaagattctgctctcgttccccttaaaacaatcttcagtgtttcctagatgaaatatttttctccatctgtcctctcttccagcttccacacagttgtagacttactctcttgctgaattttcagtttttcctaccaaaataccggctatttttgttctctccttccccacttctgtccactttttaaaccatcaaaaagctatctatactaccccaaatgctttcaacaccaataatacaaaattatattaaaaatgtgatcttggagtggcacagtaaccattgtcacggggtcacaaaaatcactgtttttaaaaaatggtttccctcactgaatgcccatgctgttcctggacttcactagaagtacaataaataatcttcataaagaacagtctgaaatcaccacatggtagactcgcctgagacaatcaggccttattccaattacaagcacgttgaaatgctagagaaaatctaaccaccaccaacatccaccctgcccccaagaaagaatttacatacattacacacatggccaagaacaagagaaagaaaacagaaagccccaaggtccagagtcaaagaaagaaattcagttagcaagtgctagctgaatccacaggaacccatagggatttgggtcacaagtgcaagtcctaagcactgcgggtggggttccaaggcccaagcagggacaaaggacacagcttatgacccaagagaagcaggagagcaaagactggaacctttcctagcaaaagtagctgtgtgcctaaggctacgtgcagcaaaaacagtcatctgtgagaaataaaaaccacatttctgttacttgtatggtgtgttgcagcccagatagatgatagatagatgatagaaagatagatagataatagctagatagataaatgatagatagataatagataaataatagatagatagataggagataggtacgtaggtaaataggtagatgattgatagaagtaggtaggtagataggtaggtaggtactagatacatagatgattgataagtaggtcattagacagatgattgatagatgataaatgataaatgattgataaatgatagagagagagatgatagctaggtagataaatgattgatagaagataggtagataggtagatagatagataaatgattgatggaagacaggaaagtaggtaggtaagtagactgatgactgatagatagtagataggtagatagatgatacacagaagataggcagatagataattgatagaagataggtaggtagataggtgactgatagatgattagatgtatagatagatggttgatagaaagatgatagacagatagatagataaactgattcatgaccaactgattcaacacccctagggctctggcagaagcaaaaataaaactactttatagagacactttcatagcttacattatagagaattcacaaagaaagaacaatcctcactgaagataagctcacaagaaaattttgtaaagtacatgaagaaaaaaaccaaaataagtagattttagtagatgtagtagatacaaaaagattgaggattagcaccccaaacagcatggataaaagatcaaacaaaagcatctataaagttaatttaaaatgactttttaaaaacagaaatttaaaccataataaaaagcagcagagtataaatcaataacagacagagctgaaataactgaagacaaattccagaaataaaaatttaatagactatcttaaaattagttattcaaaaatggtaagagaaattactgaactacctagaaagaaggaaaaacagagatgttaaggagtgtggaggctagcatgagatgtccaagtgaacagtgaaaatgagggataaaaattattcagaagatatatttggagataaataataaccagattttagagaaagaaatgagacttcagatttttttttaaaaaaggagtcctgagcaaaataaacataattaaatccacatctagtcatatcatgataaaacatcaaagacaaagacaaagtattaaaagtgaccagagaatagaataaagattatctacaaaggaaacaacctgatggatacaagatttctcatcagcaacaacagacgccagaagggaataaaataatgccttcaaagtgctgctggaaaataactggcaacctaaaattctacgtcaggcaaaactaacattcaagagtgagtataaattgaagaaatgttgagggaaagaccaaaagattttactacttacagacacttaattaaagagctattagagtatatcttcaataagaagaaaattaaacccagaaaggaaaaaaatgaaattcaaaatacaaaggtaaacaggctgggcgtggtggctcacgcctgtaatcccagcgcctcctgaggcagtcggatcatgaggtcagaagatcgagaccatcctggccaacatggtgaaaccccgtctctactaaaaatacaaaaaattagccgggcatggtggcgggcacctgtagtcccagctactcctgagaggctgaggcaggagaatggcatgaacccgggaggctgagcttgcagtgagcccagattgcgctgcaccactgcactccagcctgggcgacagagccagactccgtctcaaaaaaaaaatacaaaggtaaacaaagacaattatgagtggatatatatgcatcttaaattcaattttaaaagaaaattatgagttgataaatcaagataagcattgatacaattaaagagataatagtaatgattaactttagaaatcattactaaaacaaagcagaactaaagaactaggtaacagtaacctgagagctggaagtaggggagcagagtcagagggccttggatcgtttggaaagtgggtagaaacaatgcttgatgtcagactttgttaggtgagggataattagacaatcgtaagaagagtctaaccagactaaaattagagtgtataacattcccaaaacaggagattgggataggcagcataaataaatttgataaagtcaggaaaaatgaaagtcacaaaataagttgacagtaacaactacaaatatattttgtatatattgtaatttacacaatatataaattaatctcacttgtcaaaacataaatattctcagcctggatgatttttaaaaatccagttatactctgtttatgagagatgtatctaaaccataaataaacagaaaagtttaacatacatttactgaaaaagatatacctgatataacataccaaaaaagaagttcagctatcaacaaaaagaaagctggaatagccactttactatcaggacaagttagactttaggataaaattatttattagggataaagatgagcaaagcttggtaataaggagcaataattcatcaagaagatataaaactccagaagctgtgggcaccaaacaacacagcctcaaaatacatatgcaaaaatcaacagaattataaacagaaatagaaaatccttcattatagagagaggttgtcgctctcacctaaacagctagattaagtagacaagcaattagtacaatgattctcagaggatgctttgtgagacttcacctgttgcctgacatttagtggccaggacctaaagctgagggtttggaggtgtctgggaccccacattctgaattgtctgaaagaaaagtcagacaatttctttcaccctctatgcaccccacatacaggggcaccagaaccagtggggtgggagcaaaggggtgggtacaaacaatggaacagacctcaccctccagattcccacagcccatcccccatgtcttgggaggcggtttagggaggaagaagggtagaatcacgtaagatcttccatgggttttaaaattgcatatatttattgaaagtatacaacaggatgttttgaaatactcatctggatatacatagacacagcacaatgattactacacagtgatactacagtcaaacagattaacatacccatcatctcccattgtcagtgtctttcttggggacaaggggatggtaaaagaacctacaatccatgtaagagattttattagaccagatcagacttttaagtgattaaaggagactggaaagctcttgaatctactccagacagtaacaagggatgtaaaagagagatctgtccaaacgtggatgaaggcaaaggggaagaaaatttgctgaatgcaccacttatacaaagatctgaaaacacaacaatccagctagatctagcaggcattaagggaacctgaaccaaactgaaaatacatactattttcacgcccatgtggaagatttctaaaaacgacatagtaaatcccaaagaaagtatccacaaatttcaaagaatgaagatccacacaacacgctccctcaccacaataactcgacactggaaaaaaacaaaggtatctcaaaaaaaaagacttaaacttaaaaaaataaaaacaattatgaggcaatcaaagaaaattatgaaagaactaaaccaccacaaaaatcagtacgtgaactcaatctacttgtattcatatggataatctcaacaacataaccttgaatgaaaaaaccacttgcaaaaggatatgtatagaataacaccatatgtgcaaaattataaacacatttatagaatacacatgtgtgcaggtgcacatgcatatgtgtgaaatctgtgctgtatacaggcaaagagaaagcagagtcacgtgaacaggaagaaaacacacccatttctggataccaaatggaagaggaagagactgggcaagaaaaggatcaaatgaatcatgcactctgtttgtaagctgtgtttcttcaaaaagactcagaagacaatacaaccaagcattagcgtgtgttgaatttggtcaaaggcgtttttcgttttattatgactggacttttgtatatttcaaataaatagaattaaaggagaaaagttacttaaatgctccaagccatttttaacacggcttctgctcctctgagcacctggctggtgcctttagagtggcgagagatgagaggccacaagggaaggatggagggagattcaggttcacaggttctttgcaatttaacatagcaacgctgcgatcactattcaaacacacagcaagtaatggatggcacttaatatgcacttcggtttcttccactgcccttgtgcaaagtaaggcttcccagaaaacaataagaactaaaatgttttcctgaaacaatgctagattcctaaaagcaatacccaagcttgagccataatgggttcaagggtggtggatgaaacacatcttcaaggttactgttagttcactgccatgcgggcttctatgcaaacggcaacattcaccatccaagaaagtaaagagcccagactcagtctccctcttccacagatcaactgggcccaaatccatccacttctctgcattcagctctttcattagtaaacctgatactagtagtccacgtgcgcgcacgcgcgtgtgtgtgtgtgtgtgtgtgtgtttagcaagaggggcttgaattcctcaaagtctcaatgaaaactcagtgtagactgaagcaggggagattgaactgcaattgtaccagtgcttaaagacaatgaatgtttgatctgagcaatcattctgtgctgtggtgtgagaaaggaaacctacggagtaatacccctccttcctgtgaccacatgggctggactgtgcatcttggccacctctaatgcaatgcaacaccaacccacgctgtgtctctctctgtccttggcgaggtcctacacacaatgcaaggaactgcttcaccgcactggccaaggacaacaagaataggcttgaggggagattgaaaaagaggaagaaagtgtttcacacagaggagaaaagaagttttagattaaaagagccctcatcacttcccatgtgctctcaccataactgccttggagggaagcaatccctgctatccacaaaccagcaggactggcagaaggtggaacacagaggtaatcccttccaggggctcagacccaacacaagggcttcacccttggctcacttcttctcctcgtgccacgcatccaaaccctatgcagaataacacgcatgccctcatcaccgcccacctccccacctccactgcaacgtccctggtccaggccactgtcacccctcaactggattattatgttagcttcccatgttccctgcttcaaaccttgaaactactgtccacaaggcaaccagcaagatctcccgaaaacatccatcagatcacatcactcccgctgctcacaacccgccaatgctgggcttcccatcacacagacccacggcccttagggaacctggcagcaccccttcatcacgtggcccctctttctgtgacctcatctccactcctcccctctctccatctggccgccctgacctccctgctgctcctcaagctcagaaggcaactggcaaggcaactggctgttccatgtgtctggaatgttcttccccagatagctcccggctcccccttcgcctcccacaggccctcactccagtgtcagtctttccatgactgtcactctataaaatcctaacccccaacactctccatttgctgcctctgcctcatttttctctccttagcatttatttccaccacagcaggcctttgctcatttgtcttattgtctgtctgtctcctgcctgaggatggggacattcatctgtttggctccccgctgcatcctcggcacccaggacaggggtgggcacggagtgggcaggcaataggtgtttgttaatggaattctaaaagtaaatgacaaaagagaagggaggtgaaggcagatctttgttttctggtttataaacttagtgctgggcaggaggaaaaaaagcggggggttcatgtgaagctcctttcctgagtcaacatggtgatttaaaataaactaaatttagttggagaccttttaaatcatttttctcaagtcagttatatgtgctctagctcataaataggaggaagaatgcgggtgacattcccaagactgcagcaaatgtcggccaagtgaaaaacacacagaatgtcctgaagatccagcgacgtcctgaatgtgacgcgttccagttcacaaaagaggagtcacaaaatgtttacaaacctttaccatcccattgaaatggaccttcacattttcctcaaaaatagctttctaaaactgttactggtttacattaattttacctttcttctttttttcccctttttctttcttattttagaaataaagtaataggattagctttttgattaaagcatattaataaaattttgacattttatttgatttcaaaacatgttccagtttccatcattatagtgggtcctgtatgccatgtttatgttttgaaaggctgaaattatgtgtgatcaacaaatttattttatatcaagagcatctgtacatattaaatcctaaatgtgtcttgaaaaataccccctcacctttctctatcctgcattttatctgaagcattgtaagtcttcatgaaaaacagaggaaaaaatgaaacacagtaactaactaggaaccattagaattattttctttgacatttcctttttttttttttttttggagacagagtctcgctctgtcacgcaggctggagtgcagtggtgcaatctcggctcactgcaacctccgcctcctgggttcaggcgattctcctgcctcagcctcccaagtagctgggactacaggcgcctgccaccatgcctggctaattttgtatttttagtagagatggggtttcaccgtgttagccagaatggtctcgatctcctgacctcgtgatccacccaccttggcctcccaaagtgctgggattacaggcacaagccaccatgcccggccctttctttgacatttctaagcagtagatatttgcaaaccatgttaacgatctgtagatgtatattactaacaggcggggcccattgaaatcctaactcttctccatttgtttgctgattcttatcagtttaaataaaatgttcactcttaaactacattttaagcaccgcataggaagaaggtgttcatctgaggaagcagtgaacggacatcataaacttagtcaagactgtttagtaaaatcacaaatagaccaagcagtttcactgctgtgagtttaaaaaaagaaatcactgatctttagtcagacatagttttctgaacgaaagttagcacacgcggcccctttccagtctacagttgacatgtgtcttctaagtgactagactatgaaacctctaacactctcatcagagttaattcagagctagtcactaaagcacgccccctgaccacatcgtaactactgtgaaaagcagtccttatagaaatcatgacgttcttttcctttgtttgcagtaggttgttcatcgttttcatgagaacataagggccctctcccaaatagctcagtccccaaaatgcagacatcagcaaatgacagcaggtaacgcctgcagactggtgctcgccgctcactgtgaaggcaagcaggcttctgcctcagttttttccccctttctcctctgatccattccaatcaacaccactgacagtggacagactgctgtccgggtaagagtgagggggacagagggcctgaagttgctccattcgtcctcatcacgatgggtaaagaagggacttcatgtccatgtgcagttagcttccaaaagacaaggaaatctcccacctagaaggggacccccccaataccaaccacaggctgggccccccctcttcagccggcccctgcccaggtcctgctgaccaagcctcctcaggacacaaggtcagttcaggacttcagtggcctcatcccttgcatcccaccttctgagttaaagtctttcagaaatacagcaccatgggcttctagagctgcatggaaccctggagatcatcccactccactcgttgaacagtgggggaagccaaggttcagcaaacgggattcttccctcaggcttcatatgcaatggaagggcaccagctaaaagctaagcgctttgactcagagccaaagaccagggacctttctagcaccttcctcctacatataacttatatgtaggagaaacagttgtttccatgagcccatagaagaaatgtgatgtcaaagtatgggagaacgttggatagcattaatgtctagtcaatacacattctccccttgttcttacaatgaatcccaatgttgttcagggccacaatatcttcaggtacaaattacattcccaggcttccttataagatgtggccatgagagggagttgtggcctaggagatgtatgtagacatctactctgggtttctgggaaatcctgccctgctcttcctcttagggacaccctcctacctcttccatccttgggaccacgcagatgaaaccacctgcaaagttggcaggcagtggctagaaggcgactgggatggatgaatggcttccttgagcagccaccctgggaccatgcagatgaaactacctgcaaaggtggcaggcagtggctagaaggggactgggttggggacgaacggcttccttgagccctggactggtccatgattgctcaagtccaggtctctccttaggcaagacaaacacacatgtggggaggaaggccaatttatctgatcggtgagttgggaagaaaagacacagcatggtcagcgtggcctcagcagggagtccctcctttggggaaatatcctgtcccaaggccaaggtattattctggttggccattggatgagattcctgggacaggctctccctctgggggaagcccaagattgtccggctctactcagcacaaatgtgtaagtgtgtatcagaggtgaagtatcagaagtcttaggtatttaattattattaaggcaaagattacatcactgcctgagatacccaaatcccatcccaagcaatttcctaacaactgatctcataataataacaatcttattatgaaaaggccagtgcaaattgattcttagagacactattattcagtacaacaagaatcagaaagtcaccataaaaccatggatgtccagttaattcctcaccttactaaagcaaataaactgcctttagaattaaactggcaataccagtgctgccctcaaaactcactgctgcctcaccaatagataaaatgtcacatgagatgatataaaataaatggggagatgcggaattacctcactgaataaaatggttatctgaacaaaatgtcatgtgaactgacttgtcatggagcctaaaatttcttgagtcccattcccttaggtgaaggtgggaaggcatctcaaaaaatgcaagcatggggctttgaaaaagtcttcaagtaaaggaggcagtaaagcaaaaagggtagaatcatgagctttcttcagttcagagttagttctggttctggctctgacatgtactagttttgtgacctttttctaattagtagacaccatctcagaggtagctataaagattttgagatgaagtctgtaaagcatctagtatgtagaagcatagaataaatgatagctgacaattattagagtgattattatttagagtgtctggcagtggtgtgctgacaaaagggtttttgaaaaatcatttgtttggggaggaagccctggtttgtactgactgccaatttccatggtgtgaacacttccattacagtcaacttcaagctaccaatgggatgtcactgaatgcagagttgagaagagatgcatacagtcagctctcaggagctgccaagagtcagcaacagcttctctctggttcaggcactgtagtcacacctattgacatggtttggttctgtgtccccacccaaatctcatctcaatttgtaatccccacgtgtcaagggagggacctgtaaaccccacgtgtcaagaaagggaggtgattagatcatgggggcagttcccccatgctgttctcatgatagtaagttctcatgagatcagatgattttatatgtttgacagttcctccttcacacactctcctctctcctgccgccttgtgaagaaggtgcctgcttccccttccaccatgattgtaagtttcctgaggcctccccagccatgcatagctgtgagtcaattaaacctctttcctttataaattacacagtcttgggtatttctttataggagcatgagaatggactaatatacccgtcttgatcattgggattcctctgtgtacggcaaagcacctagtgaatgaatgatttatgaatgatgggttattattaacacacaaagctatttttgtctcaataattttgcatacctttgaactgagactcagaaaaaaatgttttcatgaataagaatagataagagggacattagagcatggactgttgcttatacttgaccatgaacaccgagacagtgccttcccaacacctagcactattccaggtataagatatatggcctgtaaatgacttctggtttggactggactggactgaactggactggactggattggattggattggacaaggatgcagaaagaaactgaccataagtctgctcagaaaacattcaacctctaagagggagggaagtctaccctcccccacctcatttttatcctaagcactgcctggaggaaatgccctccaagtcccatggtggaaaccatctaagatgccccttcgtccatggggcttgctctttattttaaatacagttcagttttgattgctgaaattttcttggagccaagggattccaacaatgctactactcagaacatcaagaaattccctggagattcccaaagtaaataatgtgatataactcttacctacaattaatctatgcatgaaaatatattgagggatatgacatcttctaaaattacctgcctgaatttctagcagagagacctagggagttacatcatatgctgcctctccaaacccaacctctgaatgacctccacgaagggataacataataatgcggctgtgtcttggtaaatgtcatttattccctcatgaattttgacagagatgacatcaagtttcttccaattctaagatttgatggcaccataaatatgacttcaatttttaacaatttaatgaaaaaatccttctggaaagagctgctcatggggaaacacacctcaggcatgaggcacattttcttttccagcccttcctccaaccataacagatccaaaatggacttccaggaggatcctgaaatgagcccatgtgttcagcctctcccttaaccacatggaaagggcaggcggatgacctgcccaaggttgggaattcttcacacactaaagtccatcactgacatttaggagaacattttgtttaataaatgcaaaatgttctttaaaattatatccatgctttcattgtcaagggtcttaatggatgtgtttaaagcataaataaatatagtaggcattctgcttgcttaacctttcttcctcaccccttcatctcttcatataacattcactgaacataaaacaggacaagtcctgaactcatttctattccaagtactaactcaagtcactggaaaggtttctatttcatttagatggtacagagatgtcctgctgtttctgtaccatccccatcccattgttgatatttgatatgtcatgttcatatctgttgtctttgtttcccaaagggtttgtttagagtccactgctgaagaagaactaaatggaatctgtctctgggcaggaaggtagggaaggcctttgttttcccccacagtggcaccgacccagacaacagatgacagaaggaagagaccacaggcaggacaaggccagcctggagcagcacctggcaggacgaggcttaaaagaatgaataaggggtaggcccaagcccacacgtgtcatggagtaccatttacaactttgcccacttgacaatgggaatggggagagcagagccttccagaccatcaacagtaggatcagaaagtagaagagtctggaaaagcaagactaagccagaataatctggaagaatgcagccccagtgagaagttgacagccaagcaaggagcaagaccatcctgttaagaggcactgagtggtgaaaacagccttgtcatgaaacagggcagatgatcatctcggaacgaacaggtgcattcaggaaagataaaaatgaaaacaggaagatcaggatcattaaccggtaaaacaatgcatgcccctaaaataacaactgacaaggataaagtggcacagagtgagaatcacaaagtaacgtggagcagattgactctaatagaccttttctggccccaaaagcaaaaggtttggttggtgacatcttaagacaccttaactataaggtccctaagtggacaagagcaggcaagctctctcatttggcggggaggttgggggggaacaactttaaaacagaacttaacaaaatggctaatactaactccttgagaataggattcttctagagaaaggcaatggtttgtaggtaatgtagccattctgtcaatagcatcagcaacagcactgcctcctttacaacacagacctctcagcatcaccctctgtggggcaggagacagagtgagcagaggttagtcacatccatgtgggttctagctcccctctaccactcactagcagtgtgacattgctcaagtgacaactttgtgcctctgtttcatcaactatcaaatgagaataaaattagacttacccaccagggttgctaggaaaactaagcgttaaagggcagaacccaatcctgaaaatttagcaagtactcaataagtcaaagttagtccctggataaggacctgaaacatgaagtagatgcaattcaaccagggtcatgcaaagccgggttcagtgggaagaccactgagtctgtcagacacctcacattaagccaacagtcattgtgacctaccaccatccacttccctgacttctccaagatggtgtcaatgacacactctacctgtagaccgacttccttccccatgctccagccagtccagatactaagctgaatgtacttcagagcttcagcttcataagtcaatggagtctagaattacagcccacacacctggtatccagagagccagagaagagccttgggcacatatttctccaagacatgggatgtgtttctctgagacatttcctcatcctcctcctctctattcctcttgctccctcccctcatcctcctcctctctattcctcttactccctcccctgtctcttccctcctgctcccccatttaatctcactgtgatcctagcctgcttcactctctggccttgcagctaattaaaactgtggcccttagtcatttatttaaagaccccaaaaaaatggcacaggagatctagcaatcataaaagcatcacttttctgagattctaacagggatagctcaggaggccctacacaatgtattggtgaatctattctatttcagcctaccttgcctgacactgtttatagggccagaatttattaccagccttacggcttcataaattagctagtcagctattgccacacctcagtatactgtcacatctgtgaatttatggcattgtggcttaatgtagcatcattgtcatcactttccagtacctggagcattcattttatcctggaagataattcgtcatggttattatgagaataccaacataaacaaaagaggaagaaaacatgtaggttatggtctaattgcctgaatcaatcccagaagaaaagaagatacttgacaaagtctgcagtctttgaatgaatcttgaatgtgcttagtattattcagactcgaaatgctttgcacacttgaatgggaaagtatgcagtgaaaatcccattgaaacgccacagaacgccagccaagctaaagtgctgcacttggttggaatatctgggctctgactcctccgtaaatcaacatttaaagtgttagatacagagagtccataaatcattattgcatttcttcagcataagctagtgccttcagcaagtgtcttctgctgtttggctctttgttctgatctggtttgatatggctggtgtgggtttggtttggttcgtttgtggggatgaagaggttatgcaacagaaaggcgatgacttattcttttgctcttgctcacatctcccaggacgtaaaaacaatgccaattcaaccctcctactcatgtatgacggccaaacctgacttctggcttctaactgcaaaatccccagcacactctgcaggcccgcagccagctcgtctgcttaggaaggagcaatagtgtaatttgaacatgaccaataaaaaagaacaatggtcttacttacttttacaggttacattgtctcacaggtaaggaatggaatttttaatacatttaaaaatagagattcctaaccaataaaatatccccatcaccaagattttaaggatgccatgagtagctggtattatcaatgacatttgtgtagtgggaaaagcatggattttggagaaagaaagatgcaggcctaaacgtggactctatcattcactattgcccaaggacaggctttctctccaccaggctaaatcaagtttcccagtacacaagtgtggtggggagcagagtggttccgcagcagcaggctggtaaatttagtcctaaaacaagacaggtctaaaaatcttggaaagtagaatctgtttggaagctccttctagacattctgtcaagcacagccttgttcagtaagaaggaccttagacatactttactcatggcttcccagaaaaaaagtgaaggatgatgccatcagttttcagcatttattgagagaactcgaactactggaggatttcaaagatgcttattgggtatccaagtaagacgtcaagtaaaattttggatacaggaatttgagtgtgaagggaagcccaggaatgcaactatctgggagtcatcggtgtaggtgggattggaagccatgggatgggatgagatcacttaggaagcaacagactacccccttctgtgataaataaattccagcagattagtgtagattattgtccccaactcttatgtcctacctcctttcatgcagctccacatgtcatcttgtgacttgtgcttgcctggcagtagagagcgcactttcctctccaggaaccttgggcttggccaggtgtcttgctttgaccagtaaaagtgagcaaaagtgaaagtgtgtccgttccaggtggcaacttgaagaggaatcatgcatttctgcttgccccttgccatctccccgctgccatgagagcagcatgcctcagagagctgctgtcccttcaacctgggacccagaataaaagacacagggacctccattaggcccagctgagtccgacagagctccagggacctgaagtcctctgagtgacaaacaagtggttgctgttacaaattactgagacttttggaggccatcatttgctactgcagcaaaagctgactaatacaaaaataaaacccatctcttctggcagatccccccagaaaggagggttagtctccctcatagatatcaggccaccaagcctaagagagttccagatggctatgcaagttcagcccaaggcaatatacaaaaatgctccgagtttaccactggaatttccagagtctacttagatgctcccctgagtccccactcatgcctttccagcaatgaaaacctgctccgaagaaaaaatggctgacatcgagatgactctgagtacacaaggtgcgaagttacaggagacagaggctctctcggatctccaggtaaacacacgcagctgctcaggaaggcagcctgatccaggagcctgcaggagcctgagtcctacccagatggtcaggtgcagccccagctgtcccaggacatgcacgggaggaaaggtgaccacgtgctgtcagatagcagctcaggcaccactgtgcagtgcacaaccacacaggccttcattcagcaggggactagatttgtactctttttagccaaatgtgggccttctcatgctccacgtgtaaacgtaactcaccaaacagggcccctgctgctttccgggccaagtcagtggagaggactgaaggccggctcacagctaggaaagcagggctctgccgcgccgagggaatgggtcccaggtctctttcaacatcagtaggtaacacacacactcacagcacacaccacacaccacacacactacatgctcatacatatcacacacacacacacaccccccacacatgacatacacaccacaccatacacatacatgccacacacacatgctcatacataccacacacaccacacacacaccacacatcacatacacaccataccacgcacatacacaccacgcacacatgctcatatgtaccacacacaccacacacaatcacacacacacgtcacatacacaccatatcacacacatacacatcacacgtcacatacacaccacacattacatacacaccataccacacacatacacaccacacacaccacatgctcataaataccacaccacacacaccacatgctcatacataccacacacaccacacacacatcacatacacaccataccacaaacacacacaatcacatatacaccacacatacacaccatgtgctcatacattccacacacccacaccacacatactacatgatcatatataccacacacaccatacatacaccacatgctcagccataccacaccacacacacacacacacacacacatcagcacacacacacgtcacacacattttacatacacaccacacacacacaaagcatgcacacaccacacacaccacatacacacaagaccacacacacacatcatacataaaccccacatacacaccacacacattatatatgcaccatacactcacacgcacatcatgcacacacaccacacacatcacatatacatgccacacacacacacattacatacacactaaatacacaccacatgctcataaataacacacatcacacacacacagacaccatgcatacacaccacagagcacacacataacccacacacatcacatactcaacactccacccacacaccacacaccacatacgcaccacacacacacacacacacacactgcacacacaatacacatacacataaaatttgcatgaaataaacataaaggaaatgaacaccaagattcatctctcttgccctgcatattggattgaaacatggagcagactggccaaatttaagatttttataatttacctctgaaatcttcatcaaattcaaaacacaatttcactttttgccccatccggcagtgttgggggttttgccactggaataacacagtatattttccagtcacaccgtacatcagagctcatgtgtgtgttagtttgttgcaggcgtcctggtagcagagcgtgaggtcctagactcagagtgagttcctccctccagaaatgaaacacctaagttgctcagcactgacagcaaacatgtaagtaaggcaaaggttgccaccagcccagcaggggtcgaacttaaaatgaatctgtgcatgtgggccccttgcctttgacccatggggagcatcattccataaataaacaaggcaatacctaacagccattagatttcttcaaggccatctctgcaatttctttgatgaaacaaaattgaagttcataatttcctcccaagctaatgttttacaataatttttttaaagatcccagagttacagtaatcacatatcaaataagaacattcctgagatgttttccatttggaatagtgaaattatttattaaagcatctcggccttcatccttcaggctatatgtgaagccttcaagaaaacctcctcgtgagcctaaccacatgacttggcagcccccactcctactttctagatcatccctggccatgctccaccacccatcccatgatccagcctcggcaaagccctggctgtctccacattacaccaagcacctggctgcatgctctggcatacgccacttaaactctcctccctgggaacatcacatactggggcctgtcgggggtgggtgggggacaaggggagggagagcattaggacaaatacctaatgcatgcagggcttaaaaccgagatgacggggtgataggtacagcaaaccaccatggcacatgtatacctatgtaacaaacctgcacattctgcacatgcatcccagaacttaaagtaaaacaaaaaataaaaaaactctcctccctactcatcccggcgaactcctgcctgccccttagacacagttcatgcaccagctctgctgggagacaccccttctgtggtctccatagagctcctgtccacctccgttcacagcgtagggctgggaaaaaggttctgtgatgggacgacctggatttgaatctcagcaccgctcactggctatatgaccttggacacttaaccttcctgtatctcaatgttcttgtctgtaaaactgggataatataagcactcacttgaggcaaatgtggtagggaatagatattttaataaatgtaaagcacctagaataatacttgaaacatcacagcccttatcacaatgtattaaagttttctgtttatgtggctatctcccccactagactataagcattttaaaaagaatatgccttattattttaatatccccagtatttagcaaataacctggcacatagaaaattttttgttcagaatgttgaatgaatgaataaatgtatgaaattaaaaatatatattaatattaaattcctgctatcctgtcccaaaagacaatgtgctgtcatcactgcttgaggaagaagtacattatttcacacatcaacccaccttcatcctttgagaatttttttttagagcagaaatagactctatccaaaccatatggcataaagctgtagtttttaaagataaaggtacacttcaaaaaagtgctgactcatttcatccttagatacagaatactcatcttcagcattacaggcttgtgatggaagaatacaaaattttaaaaatatataaattcacctcttagaggtaaaggtttgaagaacagagttatttggtctacttgcaccattagtttgtttttttttaattttactttaaattttgggatacatgtgcagaacacgcaggtttgttaaacaggtattcattgtaccattagtttttaagaatccttgatctttaaaatgctacccacttggcctcctcttttattcatggccttgttctccaggagagaggctgaaacatcccttagggaacattttctgtcaaggtgctagaccaggagtgtgaagcagcgagccttaaattgcaggaagccacaacagcagaaggcagaacgctcctcaaacttgaacgcagagcctggtgctgcttccaggaagtcccaagccagcctgacttctgacagttgatctcaagatctcaacctatattcattttcacatcaagactttatttttgaacaggttccaggatacaacaccagcttttttattgaaggcaaagcattctcaattacttagatacttactaattaatatgattggcgatatggtgcgtatttagaataatctgagatgaaactcattgaagcagctttaaaaagcccattacaataaaaataatacttgaagctctttttttttttttttttttttttttgagaccaagcctcactctgttgcccaggctggagtgcagtggcgtgatctcggctcactacaacctctgcctcccagttcaagcgattctcctgcctcaaactcctgagtagctgggcctacaggcgcctgctaccatttccagctaatttttgtatttttagtagagacagggtttcactatgttggccaggctggtctcaaactcctgacctcaggtgatccagtcaccttggtctcccaaagtgctgggattacaggcgtgagccacgtttggccaacactcacttttcccaaaatgtcatgataataatattcagtgtggaaggactgaattctgagtcacctgcaaaccatgatacagtctgtagcagtggtactgagtgtaatccatagaccagtgccattttgcaaaatgttgactgaccatgatgagagaagtacggaaagtaagaagggcttgtaaaattttagagcaagttgacatcactgtgacatcagtatgagctcagtgctccagttcctctaaataaggtgccgaccacttcagacactgcagcattactcacatttgggcactcattggtagggccacattacaacatgtgaccttttaaggtcagtttgtcaaggataaatcaaattatatgaaaatctgagaaaagggaagcacttattttcataacttattttcataatctgagaaaagggaagcacgttatgaaaataattaaaatttaattaattaaatgtttatggctttttaaaatttatagtttaacattactggctaaataagggaagtcaaattagtattatgtatttataacctttattgattgattgatggcctctttttggtcagaaaaacatatatcttttttgaatgtgacaatcacagtaaccaaatgatgacaaagaagttgacattgaagaaatgaaagccaaaaaattttgtattcattttacttgaaagtataatccctcatatacaaatttttatagtttatgtagccataaactacagttttgcagccataattgatagcaaagtgctaaaaacactgtaggtcacttgaacaaatgtattggcaaacaaaacaatgaaactatcaaaacttgagtagcatttacataaaaaaattttttaaataccgagaataaaaaaaaatttgcaaaaaagagtattattaaaaagacaacaaaagtagatgttgaatatttcatgtctaaaaatgaatgtcttaaggcttcctgtaaagcagcacttacattactaaaaccaaaaacaaacaaaatgaacaatcaaacaaaaatcataaaattgccaagacattaatgtaaaactacattaaagaagtctacttggaaatgttcggtgaatctgtaacccaaaaaaaggaagcttgagtaccactttttaataatatcacaaatcagtgtttttaagaatgggctgatagcatagctgtaatgacaggaaaatactgtgaaatcattattcagataacaatgaaaataaatcaacaacctgcttcttttcttcagaaagtcttgccaggaggaaaaaaaaaatcagctgaacaacatgcttagagacatagtatataaaaactaatgcattaaattcaaggtttttacatttattatgtgatattatagaagatgaacataaagaaccgtagaagcatgcaaggcttgatggctgttatggggaaagattctgacaagaatgtttgaaatgggaaatgaactcttagcgttctggtaggaaacgagttttgtcccatgtttttaaagatgtgaattagacagccagactttcttatctgtctgacatcctcagtatttgaaaatatcttaatactcctatgcaagaaagggatgtggtaattttttgatgtatatctttatataaccatgcatagaagagtctgggaatatacaaaacaaaataataagagtggctaactctggagagaaatgacaaggagttttctcttcttttttttttttttgtgaaacagggttttgctctgtcatccaggttggagtctggagtgcagtggtgtgatcttggctcactgcagccccaacctcctgggctcatgcacacctcccacctcagcctcctgagtagctggggctacaggtgcatgccaccacagctggctaattgttgtatatttttgtagagacagggttttgcgatgttgcccaggctagtctcaaattcctgagctcacagaatccactcgcctcagcctctcagagtgctggaatcagaggtgtgagccaccatacacagcctgctttttctttcttttgcttctctgtatttatagttgtttttctaccctgaatgctgcctatgtcattagaaacaaagaccacagagtcataaaagggtcacacaagttcaaccatttaaaaaacattgtcaagagctttgcccatctaagggaccacatgagcattaatgactgatgggctccatacactacccagaatgactaacacatcaatgaaagacatgatgatctaaggaccgagggaggggtcgatctaaaacacaaaatgtccctgctcaatagccacctgcacacccacagctactgcgtggagaaaagagagagctggctgcagtccccctcctgggggaaactgtgaagcacaacagagacctgctgtctggaacctggtggctccctccccacagtgagcataccacacctgcactctcatgcccccacttctctcatggaacttccctgtcccttccctccagaagctacaagctctcagaatcacacctttcgtgctccagagtcaacaaggctgagtttgtggtgggcaacaaacagactaaatcttcacaccatttctcattaaaccatccctgttcatgagatctgcattaaaacttttttctcttttgtcaagagataaagcagcagtacacagctttagaggactagggcctccccagtaaccctttcctccaaacctttctaaacaaattatcattatcattggtgccgttatcagtatactagtactgttaaagccaagagatgacctgttttaggcaataacatttacaattcaatagcagagtttcctgcacagactgtactatttacagagtcctgcagcccctggacaagggaacacaggctcccagctgcctgcttgcagagttcccctgtgggaggcagtgagatggaaacacctggatgagaggccaggagacataagctcctccatccctggttctttctccagggaagtaaactaaggcagattgcccattctctctgctcctaaaccagaggcaattttaagtggcttccagcattgatacactaggtctctatgaaaggtgcaaacctttccacactcaatggattctcatcacaaccaaagcagcagggcagtgtattagttaaaatccattttagttgcaagtgacagaagataacattgattttttaaaaacaatggtggcttaaaaacaaacaacccaactcaaaaatgggcaaaggacatgaacagacatttctccaaagaccattctatggccaatgagcacatagaaaaatactcaacatcaatgagataccacttcacactcatgaggatggccagtagaaaaaaaatatatcaagtgttgttgaggatatggagaaattggaacccttgttccatgctggtgggagcatgaaatagtacagctgctgtggaaaacagtatgacagttcttaaaagattaaatatagaattaccatgtgatccagcaattatacttctgggtatatacacaaaagaatcaaaagcaggaattcacacagatacttgtacatcaatgttcataacagtattaatcacaataaacaaaatgtggaaacaacctattcatgatcaacagatgaacaggtaaacaaaatgtagtctatacatacacgggcatattactcagccttaaaaaagaaatgaaattataatccatgttacaaaatggatggcccttgaaaacattatgcaaagtgaagtaagtcagtcacaaaagaacaaatatcatatgactccacttacatgagctacctagattaggtaagttcacagggacagaaaggagaatccaggttaccaggggctatggaaagggggaagggggaattagtgttcaacaggtaaagagttttttgggggatgatgatttttaaagttctggaaatgatgtggtgatgcttgtacaatattgcaaatgtgctcgatacccctgaattatattcttaaaaatagataaatgataaaatttatattatgtatgttttaccacagtagatttcttgttaataatggtggcttaaaccataggaaaacaagcagataggcctggtatgattatcagggacccaggttccatccattcagccacctcaacacagggcttcctctttatgatccaacatggctgctccaactccagtcatcatctcagccatgcaacagggaggtgggaggaggaaggacaagggcactcctctacctggaagttcaaccttcccttgagggatactttctggaagtggcacacagtccttccattctattggtcagaacttggtcacatagttgcacatggcttcaagggaagctgggcaatgttgactttgttctgggcacccatcttttcagctaacattgaggaagaagagacaaacaagtactgaaaacaacaaccaatcctgcataagttgaaaatcaccttgagtgcaaatgttttttagcacaggactgcacacctttatgttttcctaggatcacagtcaaaaagaagaagctttaagaaatggttctgaggactttcttctttgttaagctcactttgcaacataagaggaattcagacctcatagggatgtgagctacatagttattcaccatataccctcaggaagaagtagagctaaactgagaagcactacaaagaaaaaataaatgaagaagaacaaaaatgaagataaagggtcactttcttaatgcctcatcctatgcattttgtagaatttgaaacccctggaatggaaagcataaagctctgacaatctgggctgcattcagccttggcagaaaccaggatgtgaccactggctcattcctaatgtttcaggtgggtaacaaatatttgctttttccggggagttgaccacacaccctcttccaattccttcaactcggactgcatcttgcccttgagaaaaaagatttggcaccttcagaacacaccattccccacacttcatttcccattaaggttgtcttggttaaaaatgttgcgggccaagtacatggtttcacatactcacatggttaagagagagaataggagttctatgagtcacagaaaatttggttgaaaaaaaaaggaatcaggaagaatcagtaacactaaacgcccacacgtctcgtctctttaaagcacattgggggaaattttgcttttagtggtaactgaacattctgttgctgctatatatgtcattttcagcagagatgaaataactaacagcctgggaagatttttatagccttcccgtcctttaagggatggcgtggtcccaattttgacctcccttttactactttcctttcctttggataaaatccatgtaatcctctgtaacactagaacatctctgcattactgtgtgcacacctgatttccgtaccgttttcacccctcattttggcagcaatctatgcataaaggcaaaaagttcccacacccctatcctgacctcttggtagccgtgaccctcatcccagctcaaccctcctggcatctcctctctcctgccaggtttgtggctcaagtcaggaagcacgtcagccctgagacctgcaaaccgaatcccacagacagttctagagggtgtgcttgactttggaaacccagtttaactggcttctgcttgaatcatcactccattaacatcatcattccagaaagtcgttgctcaaggtctaaagcacttgaaaccttcccttatatttaatatttattacccatcttgaaggaacggcatctgaggacatcctcccatcttgtaacatggctcccctaagaagggtataacatagtgattgcaaagcaggactctgtagccaaccatccagatgcaaattctgattccatcacttcgcctgaatataactttggataagctgactaacctttctttgcctctacattcttatctataaaatgggcacagtaaaagtgcatcctcattaaaaaaatggtctacaagcatatgaaaagatgctcaatgtcactaatcatcagaaaaatgcagattgaaaacacaaagagatgtcacctcacacccattaggatgaacactataattttttaaaaattaaaaacaagtgttggtcaggatgtagaggaggtagaacccttatgcactgttgatgggtgatagggtttggatctgtgtctccacccaagtctcaccttgaattgtaataatccccacgtgttgtggagggacccagtgggaggtaattgaatcatgagagcaggtctttcctgtgttgttctcgtgatagtgaataagtctcacgagatttgatagttttataaaggggagttcccctgcacatgctctctctctctcgcctgctgccatgtaagatgtgactttcctcctcctttgccttccaccatgattgtgaggcctccccagccatgtggaaccatgagtcaattaaacctctttcctttataaattacccagtcttgagtatgtctttattggcagcataaaaacagactaatacagtgggattgtaaaatggtgtagcccctctggaaaacagtatggagggtcctcaaaaattaaaaccagaaatgctgtgtggtccagaaatcccacttccgtgtccatatatccaaactaactgagatagatatttgcatacccacattcttggaaggactaatcacaatagccaagaagtagaagcaacccaaatgtccatggatggatgaataaatgaaatttagaatatacataccatggaatattattcagccttaaaaagtaagaaagtcctgtcccatgttacaacatgaatgaaccttgaggacattaagctaagaaataagccagccacaaaaaaaagataaatatggtatgattctagttatataatgtatctaagggagtgaaattcatggaaacagaaaatagaatgggttaccacaggctggagaaagtagggagaggggagttattgtttgctgagtgtagagtttcagatttgcaagatggaaaatttcttcagttttgtttcagaacaatgtgaaaatacttaacactactgaactctacacttaaatatgattaagatggtaactttcatgttatgcatttctttttaccataatagaaaaaaaatcatttaaaaagtgattcttcatagagcttttgtatggattatatcagttcatgtgtgtaaagcatacaacactggatggcacgagcgagcatttctcaaatgtcatcgttatcaacgaattcacataccctgctccatgctatatcagcacacatgaattattttatgtttggttgggtgcctttttatttgtttgtatggagttttgttttcttatttatttttgccttctcaattttctgtgttttctgaggcctgttttagaagctttacacatctattttttaattattccttaccaggatgaaaataaaaagtagaaaataaatgtctgagaaaaccatcatctgcatctccttcaatttcataagatacaatttgaagtgccgaattatttcatttgttttgggttttaaaggtccttctttttactgaatgagagggatgtagattggcagcagttgatatgaaaaaaaaaaaaatcaggttgtttccaaaggcagtgtgatgggctgccctaaagctgctgcctcaaaagaaccataaggttcagatcacaaaatataatggtctcagatttcctagggcctgttctgtatataattctctaagaagaacattgataaaaaataatacgtccacaaaaataaaaccaatatgataactctaaaatacatattgtaggaaatcaggttaaaataagtagttgtattttatctgcaaaagagaagtttaaggaaatactgctttgaaataaatgaagataagtcaaatattcattcatttattcagttctgaaattattcagccactattcactgtaagatttctaggtaccattctaggtgttcctagtccccattatgagcaaaagtcgccacttcactgtgttattcgaggagggaaaagtagatacgatgatggaggcatatttgaggtcgatatgagaaagttcacgctcacaaacacagctgtgcataacgggaatggctattttatgagggagtaagttccctgtccctgggaatatgcaggaggagaaaatgtgagcattaagaatgccaagaagaaacttctaactagaccccaaatatctggtgtagataacaatcaacctctcctccaaccaaaaactcttcgagtccagttttaaggcacatcaagtggagagaacatctgtattctcagggtgacttcaggacagaatgctaagaaaatcttcactactgacttccatgttgcctgcacgaagacccaatattccattgtttttaacacagacctataatgaatctgtaacacttattctattaaaaatagtcagctccctttgcatggatgcagattgatgatccatttttagaatctcaataatgattacaatggcacagcatgtcacctggaaggtatactgtagaatccttgcctacagggtttcactgaagctttgaaaagaacatgaagataactgctaaaacttggaagcaaccaaggttccttatataggtgaatggataaacaaagtgtggcacatcaagacaatggaatattatttagcaatgaaaggaaatgagccgccaaaccacgaaaaaacacggaggaatcctgagtgcatattgctaagggaaaagtcaatatgaaaagcctacatactatatgactccaactacatgatattctagaaaaggagacagtaaaaagatcagtggtttctatgggttagtgaggaggaagagaaggatgaatagggagagcccggggcatttttagggcagtgaaacttttccatatggtactatcatagtaggatctgtttttaacatagacccatactgaatcctttctgaaaaatgtgagcctactataatagtatagcctactgtaatagtaggctcacatttgtcaaaacccataaaacatacaacaccaagagcaggccctaatgtaaactatagactttaggtgataatgatgtgccaacctagatttatcaattgtaacaaatataacacactaaaaagcaaaaacaatcaaactactctgagataccaaaaaacaccagatatatgcataaataaagaaatagtgagtaattcgataaatgaaaaagtaaccaagaggaaacttcacaggcatgattcctttaaggaaacaaagaaataagcataataataataaacttctcatttctaaaatccaaaaactgttacaaaaggattcaatgtgatatttttaaagcacaattattgagcataaaatacaatctggaaggcatataactttgcaataaccttttctgtgtttaggtaaggttgactgcagagttgagagctgggccattgacatttgaggtcatggtggcagcagtccgccactattaccacctatgtccaaacatagctgaccctagcatgactcaggttgaataatattcaggaaatgaggccttgggctagggtcccagctcttgcaatcactagttccacaatttgggggaggtgattcttctaggtctctattttcccatacaagatgatatggtttggctgtgtccccatccaaatctcatattgaattgtagttcccataatctccatgtgtcatgggagggaccagggcaggtaactgaatcatgggggtggtaccctcttgctgttctcaagatagtgagtgagttctcatgagatctaatgattttatctggggcttttccccctattgatcagcatttctccttcctgctgccatgtgaagaaggacatgtttgcttccccttctgccatgattgaaagtttcctgaggcctccccagccatgttggaactgtgagtcaattaaacgtctttccttcataaattacccattctcagttatgtacttataggagcctaagaatgaactaatacacaataaatgcacagaagaggtcagctagcagttttcacacccgtctccaggagaagagaagctaggaggagcaggagggcaaggagggtccggctcccaccaaaagagttcaccctctgggggaagggctacttattgggcttttatgcaaaattttatttgaacaaagaattcctcagctttaaaaatagtggcatctggttccttttccctgaaggtatttactcaagccaaggaatgaagcacctgtgggtgaagagcagatgaaagctggaactataaaagccggagggaagctttttctcatttctaaggagattatcaggaagaatgtactctggcccctggaaacccatccaacctctcctctcccacctgggctggctgcagcagctctgcaggatgtcacccaaaaagctccgttcccaaccctgcggcccacagcctgacaggaaaaagaactctctcaacctggattccggggccctgtactctaatagagggctggacactgcctggctgtccccctgcttagaaggaagcaaatgtttattcaaaaatatttattaggtaatacaacaaactgtcaaaaaggaagaggcgaacactgttacagtttacaaacatgaaccatggattcttaacaaatgggagactttaaatggggatggaaataaagccccaaggaggggaaagatgttgtggaaatgctgcccagtgggaggcaggcttggaaccgcacgctggtctggctggtgataatctagtctagatgaagatctggacagcatccttctgctcagccactagcctctctttgctttctagtcagtgtaaaaagcatctcaaaaccattgctttcccagacttcagtctcctgaaatgtgtgtgtgtgtgtgcatcccatatgtgtgtcattttgtgtttctgccagcctttctgttgaaacttgccagagaaaatgacccacctgcgaattggcaaacggaacctgactgaataaaaactccttgattcagagcttaagaaacaatccagtggatttcttactaatctgggtgttcaaaatagtctttctacttacttgggctcaatattttggaagctattgtggtgaaatgagtgatcacgttggaattagacactgtactactaattgtgtgtccttggaaagttacctaacatttctgagcttccatttcctcaacataaaatgaggataaaaatgtccatcatgcaagattgtcctgacaactgtgctactgtctacaggatcctaagaaagagcaactaaaattatgttaatgttattaattataattttaatcatcaatactgttaataataataaaagactttaaaataatttcctcgtttttaacttactgtaatatcaactgtctgtggtagcctgttcacttgctttgtccttagtcttgtgatccatgtctttttcttatctgttagttttatgctgtctcttcacaagttctttttctgcgtgtgtgtgtgtgtgtgtgtacacatgtgtatgtatgcaagtgtgtgttccaacaggggttcccacttgcccattagaagtttatgctggggtctagataataaaagtaagaaatccaggactacacaaatgttaactgagtggattgaagagcaagagagttctcatcacagccaaacctatgagcacaatgcattgggcatatcagagaaaacgaagatctaaggtaaggtgtgaaacacagcacatgcaactcgaaatgctgaggggaagatctggtaggggggcctggtttgtgaaactcctccgatctgggtgcgccagtccgggtgcaatgtccagctcagccacttgtccccatgggaccttgagcaagtcactccatgattccatgcctcaggttcctgctctgtgagttgggaataacagagcccctcccagtgggttgttgtgaggatttggggagttaatccaggtaaagcccagcacagtcggcattctataagcgtgagcttcatcatgatcatcttatcactttgcgtgcatctggccctcctcacttacaactactgcaccccgtggtagaatgcagcactcatccaacaagacttgcaactcacttcatctctaaaatgtaacaggtccaggtaaaaaagggcagattgaacttgtgggcttacctctagaataatatcactaaaagtagaaattcaaatggacaaagggaagaaagaagagacaacagcctgtggaagatgtttgcaaaatttggaagatggaaagcaaataagagaatggcagttgatgagtgaggggacctccctgccagaggatggggggagtcagtaaagggaaaggcaatttgcaacatacgaccctgagagctttggaaatttgaggtcactcagagggtgggagcagggcaaggaatggggctgaaaacatgagagtgtatgagtgttggagaaaggggaaattcaagtgctccctcctcctcccacatcccctttctgatcccctgcagccaggtaaccatcctgtgcctagcaggtaatttagggttcctctccagagagaaatcagggactccaggctctgcagagtgagggaatgaggcaacatactgaaaagggggaccaagtgaatggcaaggtacctcccccaggatcttccctctacttcaccctcagaaccctgcagccaggctctaacaaccccaccctcattccaccaccctttccacagctgacaacagcagtattctcccccaggagatgctgaccaacccaagagaaagagctacttagacagtcacttatgggtccccaatgacatagtcaggtgctgatacccatcacggcacacacccccagccaacaagccccacctgggcacacagtttcctagtgaattattctgaattatttcctagtgaagagcatccaaggtccaccagacacttgtgaaaaacttccaagcattagaaatgatgaccaaaatctaacaatcacgaagaaaaaatgtggagcaaaaagagatgttttaactttaaaaaaaaaaactatcattaagatcctaaagataagaacaaataatacagccattaaaaaaacagttaaagatgccttgaataaaaaggatcagagaggaggttcaacatctaaataacaagagttccaagaagagaaaacatttaaaaatggaagagaaaattctcaaagaaatcatacagaaaaatttcccacaactgaagaggcccactgagtaccccacataataaaaggaagaagaccctaaacaaggcacatctctgtgacatttcaggacactgagatgaaagagaaaaacctaaaacattcagagaagagaaatgggaaccaggatggcatcccaagcttcttgataacaacaataagagctggtagtctatgaagcatcactttcactttccaaatcgtgagggaaatgtttcttaaagggaatcaaaggcccagccaagccatcaatgtgaagaactacaccaaccatgaggctgacaggataacctggagacaggggacccagcatgaaaaccaacagaatcctagggtgccagagggcagagatgccaggacagccacgcctggaaacagccggttccatctgtgagcacagggctccttaaagcaccctcccccacaacaaaacaataaaaaccctgagagatgaccaaattcattctaacacactgaaaagaggaactggttctgccaaggagtttaagggagtcttattgtaagtacttagaaaaaccaaggcaataaaaaaatcattgaaaatcaatgaaaaatcaattgaaaatcattgaaaatcaatgaaaaatcaattgaaaatcaatgaaaagttattgtttttgaaaaaatcgaacattacagcacactatatgactcagttctaagtaacatttacatagttataataatgttacaaatgcatatcaacttaaccaacattatgatttacctacattggaaggatggagaaacaggagatgggggaagggggcatgagctaaattctcatctaccttaggagaaaattgataatgtctgatatggtttgcctgtgtctccacccaaatctcatcttaaattgtagctcccgtaacttcaacgtgttgtgggagggagccggtgggagatgattgagtcatggggtggtgtctcccacactgttcttgtggcagtgaataagtctcacaagatctgatggttttatgaggggaaacccctttcacttggctctgatctgtcttgcctgccgccatgtaagatgtgcctttcaccttctgccatgattgtgaggcctccccagccacgtggaactgtgagtccactaagcctctttttctttataaactacccagtctcaggtacatctttatcagcggtgtgaaaatggactaatacaaagtccaaatgaaaagctcatgaaaacgcagtgatgtatcaacaaggaggtaaatgacagaagaaacagctaagaggacagcagttacctctaggaaagggggctctctgggaaaatggaaggcagagaactgctatttttcattataagcgcagaaatactatttgacttttacaactatgtattagcatgagaaatataacaactagaatagaacagtgataaaacatgtagaaaatttcacagtgaataaactaacgcatacatagataggcaaccgttttctgagagtcagttgtgaacccagaaaaggcataaaatccagttcttcagagccatcccatgctcattgcatgtaccaccagtttgcttcctcccaaaattcacatgttgaaatcctaaccctcaaggtaatggcattaggagctggggggcctttgggaggtgattaggtgttgaggatggacccttcatgaatgggatcaatgcccttataaaagggaccagagagagctcccttcaccccttctaccatttgaggacacagcaagaagatgccatctatgaaccagaaaatgggccctcaacagacaacaaacctgccagtgccttgacattgaacttcccagcctccagaactatgtgaaataaagtcttgtttatgaccatccagtgtacagtattttgttatagcagcctgaatgaaccaagacactcatcatcagggctgttgcatctgccccttcccaccacagtctcactaaagcaaccggaaagaggcaccaaatacgtccccctttgttatgttagtaacacagtcatgttataatacaaaataaactaagcaatgtcaaacagatcaacataattatttagtatgacataaacctcttccaaatgcacatgcaaattttttcattatttaccttttaaaagccttaaagcttaaagtgaaaattagtgtgaaaaaaaaaacaaatttctgaaaggtaatttgtcagtctatatcaaaagattaaagatacatatctttcatcacacaattccactttcaagagcgtatctcagtctgataaactacagcatggtttgaaacagtaattttcatcttggaggcatgtgagaatactgattcctgggccccaccccaagacagcctgattcaattggcctgggataggacctgggcatctgcattctgcactcaagattgggaattcctggtttataatatagaaaactagaaacagcctgaatactcaacagaagaggactaggtagataaatttataatgacagagacatacgatggaatactagacagtttaaaagtaatgtggcattaaaaatatcattaagcatacctatgaacatgggcagatacttctaatgtgctggtaagtgaacaaaacaggtgccagcacatatatataaaagtgtatatataatatgatcccctttggggaaaaacatgtgtataagagagaaattccactatctggaatgaaatgcattacttttcaatagccattatgtctgagtgcagaaagatttaatttaaatacttttgttcatctgtatgctcacggtaaacaaagtattattgacaccatcttctaaagttcaaaaatgctgttatatatcacttgtaagttttaaacattttagtactgttcatatagatttcacctcacaccccaccctaaatccatatacacagacccactcaaactctcacctgcagattctcagagcacactacatcctgccaagtctccagcgtgaagaacaacttttgcataggtttcatctttcctttgtattaataggtaacaaagtctggctgcctcaaactcagaacatccttgcaacactgttacacccactgatcttccaagttcaccttcacaaatgtgcaagggatgagggggacaaagaccaagtcaccagcaccactcctgatcccccagattccagcccaggtaaaccattcagcatcattggtcaaaggtattgggtcactgaaggaggagaggggtagaaacaaggcattgattcaaatacttccaaaatatgtatgtgttttcccaagcagctgttactccccagcttgaggaaagtgctgagttacagatgatggagtatgaaacactgagagagggcacaccctgtgccttcgcagcaagaatggcagagctacagtggctttggtgttttacttcacccacttttatgcctactcttttcttagcgcccccttcccttactcattgcatcaaagtgatccactgaaaagaattaagtcaactgcagagttccagatagctatcctcaggagttttaaaacttaagatgaaagcagtcagggaattaagactaaatcccgaatatgtaagaaaagggctttcccacgtggcacaatacacgtactgtctgcttcacaggtccagcctggtagcaatcaggcaggataccagagcacgcaggaaatccaaaattaggttttactacctataatggaagatttacgggatggtttaattggtagtctcaggactaaaacctgaagcaggggaacaaaaacgtctatctggacacagccagtgagcccacgtgcaccccatgacactcgctcataggacacacaggcccgaggctgcaggggacagagtaaggtcacaactcctccttctcccaaccttgatgcacaccaaagccaacaacatgctatttcctgttccttttatttaagaggcaaatttgtttcttgtggtagaatgggtcttcaagctacacacacaaactcaggtgttccgcaaaacaaaagaactcattcaattcagtcctcccctgtatttccaaaccacaggggcaacactcacaagctgcaaagaggattccgccccaccgggaatgcatcggtctgcacctgtctgttgccattttcagggttagcagggccactggaaaatttcctcagtaccattttgggtcaatgtaaaggataattgaagtgcatgtttctgtaaattccacgtgctcagagagatttcaagtaaacacaggaaaataagaactgtgggcttgagccatatgttggctggccacgtggggcaggaagaacacacactgtccaggcagtgagtaactgaaaaccaagtgcccacagacaccatccactgccagaacttgggaagctggggtcccaagggacagtcccctctgctcaccctctcccctcctttctttctcaccctctcaacaaactttagtggagttggctttttttcctagaggccttcatagccactttttcccctctccaggtggtagcctgggacctactgtgcagaaggacacacaggtctgaattgaggtcaagccaggaagaggaagaagtgcagagcagggcagccactggcttctgaaatccaatggaagaggcggcaccatttagtagcatgacattctgtctgcaaaccaccatgatgatattgttactaagtagaagaatcccttttaaaagaactttcgatatattataacatactataacaagatgggaagacattttccttttaataaattgattttcttaaaggagatttcaactttccagtgatggacacttttcctggcttccacttgttttctgaaggtttccatttgggtgtgatttcttagcaaacaagagccttcccaaacattgcctgcagacatcttggtctgtagaaacaccttataaggagatcaacgtataacacagtctttttctacctagagaattagcaaagggtgaaatttggtatgacaggggtcttccctggattcctttcaatgtagtccaaggaagaactaacttaggctgaattctattaagacaaggttatcacaatatttacaagattatttatcaggattatatcaattaaatattttgggggaaaaaattgccatacaaaaatcatattaaaattgagccaagcagtgaaacaactctgaaatggcctagaaataacatgtatttgatattcactttttctgaatacagatgtgatcttcatgccatcattgaccccaggtggtaaggatcattaatgtttctagaatcctacactgggcagctgatgcctgtaatcctagcattttgaggggccaaggagggagcatctcttgagcccaggagttagagagcagcctgggcaacacagcgagaccccatctctacaaaaatattttaaaacttagccgggcatggcagcatgcacttgtagtcccagctacttgggaggctgatgtgggaggatcatttgagtgtgggagatggaggctgcagtgagctgtggtcacaccactacactccagcctcagtgacagaatgagactctgtctcagaaaaaaataaacgattttaaaaattttaaacccttaaaaataagtaaataataaattcctacactgttgtacagttaacggccccaattactaagctcaaagggaattacccagaaaaggcaagaaaaacctaagtgtgaactatggctatagagaaacaaatatatggcttgtaatataaataggtttcatatacataagagtgtaggcatacattgcaatgtatcatctcatctgaccctgctaccaaataaaccacaatgtgattttgctactgtggaatccactgtgaaacgagtcatatttcaaagaggtatttttagtgatttttaagggcaagaattcacagacttcagatctgggttccacgtgaccatgacaagcacttggtcagttctgcggcttgggctccaaattcaatgtgtggatcaccactgactcaaactaactctatctgtaagatgattcaaaagagacaatttggaaaaacagaagggaggaaagacttgagaaagagtgagcttttacaactaaacagtatttgcttgaatttaaacaccacttaaaacatagacaacaaagacaaaaagcatcagtgaaaatgtatgtcccttttacattccaaatacaggcccagaaagcaataagcaaaaggcacagctgggctctgtatagccgacttgttgatgtttaatgcaggtaccactctgatctcagcccccagatagaagcatatactctagtgatggcccaggaagacgtcgaccagcacaaagcatcaccacacttcccacattctgagttggatgcaaccattctcttagaaacctagtcttgactgggtgtggtggctcacgcctgtaatcccaacactctgagaggccaaggagggcggatcacttgaggtcaggagttcgagaccagcctagccaacaggacgaaaccctgtctctactaaaaatattaaaaaatcagctgggtatggtgaaatgcacctgtaatcccacctacttgggagactgcggcacaagaattgcttgaacccggaagatggaggctgcagtgagcaaagatggcaccactgcactccagcctgggtgacagagggagtctctgtctaaaaaaaaaaaaaaaaaagcaaaacaaacaaaaacaaaacagtcgcttctgcactcatggtaacatcctttaccatttaatctctcctagaagacagggcattgccataccattactcacttgaagatgagaagtggaggatttgttaggactgcaggtgatgaggagagactcaaacagaatgttagattctgaccgatctgctctggtttcacacacttctttcccttcctaagaatctgcttttcccttcatgtactttttcctgttttcagtatcactgggtcatttctagtaactctgcttaagtgatcctgtcagctacagggcgtgggtgggttattcagctctgcctcacagaacactcaccctccatctctgagtcagttgccttttaatggaaatactattcgctgatcatgttcataccggcccagttttgtttctcttgacaatggcccaggtgtttttctcttctgattgagttttggggtaagctcagcatctttgttgttgttgtttgttttattacatttccatttttactggaggggaaagatcagagtcaatgtgatccagctgctgcacgtcagtcccgccacatgacctgcactgttacatccaaagcgtgcagggaaaaggctgcgtgctcaggtccagaagttcataaaggcagcctctcccatcagctcaccggtggctgccagcctccatgccgccttgctctctctaggctactggtttttgcaaccttctgcttttgtccactcataactttgataagtaccgtgtcaccttctcatacgtggaaaacatgtggtcagcgattcggcatgtttaatggtgcttgaacaatacaaaggggagctgtcatccatcttttgttttctcattatcagttttcaggccacgttctaaacaaggacgacaaccaacagaacatcattccctggtgtcccagtccttgcttactttgaatctcctcaccaccttcagtcctttctaaggtcacgtacgggcatccaccgtcttttttcctaaacagaatactttgcaaagtcaagtattggcatttcgtatttaagccatgcatcctcaaggaggctaaaattagttcttgaaggatgaaaaacgtcttattccttttctgtataaagcacagatatacctaaatgtagacatacgtatatgtataatgcaaagtactaaaacagtatatctgtggtattaaattttcatgtgaggagggacaattaggaaaaaaaatcagaaaatgctttttaggaggttgatcatgaaaacaggaggttggtcatgaaaaaaaaggttgaaaaacactaatttaagcctaaatgtaactacattacaaaatgtcactacttcttgctggttttggcaccagtgcctcaggtgacacagaaatactaagttttcttttattctgatatgcttaaggtatccccaaaatgatttctctaagttgggaattgaaagggttatgttacactcattcactctttaacaagtcacatacacgtcacctcctattttagaagccaatgggtattaaagcacaagaaataaaaccactgaaaaagcaaaaaataaaaaggaaagaaataaagactcggcactctgacacagatgaagcagatgattatgtttatttaaaacagcaacttattttttaatgtctatgaactaaagatttctcaggacatcttatttcatgttaagtgtccaatgcagcaatctttgccttgcaaagcccattacaaataggcttgtgcattccagaaaggaagcatgcatttaactttcccaaatatgtaatatgcaattcttttttttaaattttttacttgcttggagcaaagactgaaagcaagtatttaatctcgcttcctttgccagtgcaaacgtaactaattctgatcctcatttccatttcttccttaatctttttaaatcagggttgggccagcatttattcccaaccttttggagaagtagcctgtatttcaaatggggccgcgatgctaccgcatgttgtcctgaccagtgccgtcctgatccttgctggagaaagaaatggaggcattttactcacaatcacagagcttacgtatgccagcattacagaatgcaaaaaataactttgcaacaatctgaaagggtaatttatggagcgtggacagtaaatggggtatgttttctgtcctgaaaatcccagatgagggcaggcttatgaataattttcaaaaatcaggaagtctgtggaaatccctactgtcttataaagattgcaccgtgctcatcgcatctcccacggcctctgcctcctcctccacctcctccgaggttccttggtcctgactcctaatggcaagggccaaagaacacaggcacctgcctccagcaaatccactccgattccccctcattcccagacacaaatttccatgaaaaccagacagaggacagaaagcaggggcaggatattccaaaagcacttcagatctgcagcctgatttcattggactcgctggcttgtttcttttagtccctgggtgtgttgactgcaggagaaacctcactaacgacgacacttcagaactgtgagtccaaacacttaaggaaggacgtgcccaggaggaaggtctagaagctcagagacagtgaggaaggggcattgctcagcgatgcttagatgccttcatgagctgactctactgggagtcacttgtcatgcccctgaatccacccacacatctctataacatatgaaaactgttcagcccaaaggaaaaaataaactcgatggttctcattaatccaagtttaactaaacacaacagtttccaagagtacatttcagccatttcgcacccgcagatacccaacctgagaagctgatgggaaacggctgttttggcatcaccgagggctgcggcaggcagcacccagggggcttctgtctcccctgtggcgctgcagctgagagccacacccatgagctgatgacgtagcgtttctctcaaaggtctcccttgatgatgtggcaaactgcaaggaccaagcacagaggcacctggacaccaacccttccctgcgagccacatggccagtcaaacgttctggttaccggggatgacacgctttttccgacaagattttaagcacttgtggcttacatcaatgtggtctcgtattcattgtgtgtttagaccacttgcctcgcacgttctcatatttacacatgttcactgaacgtaacctcaagtgaattatttaagaagccttaatgtgcttcagactgctcaaatataatttagactttaaattaaatttgtactctgatacgaaactgcaatgcttgaatgcagcttacggcatcaagtggacatgcaggaggccttggaatagaatttcagttacccctaaagggctcacacctagtggcccacgttccttataggacgaaacaagattcaactacaaaatccaactcattgcctacgtttgaaagctggggagcctgcagtacacaagataaagtcttgcttctccatttgtccttacgtgaccctacaatgaagcatcgctacacaccagagacgtataatgctagacgcgagaacacacagtcatgctccttggtcagaggttttgggtatggttgggtgttttaataaaccacaatattccttctccttcactgtttggttaccaataattgtgctgccttaggtgtaaaattcaatatggtgattagagtctagagaagccacacttattttatttagcagtttttgttttatttttacagtaagcactgcccactgggaaaaataaaccaaaataaaaagagtgaaattcccttattatgcactagcgataatgaaaacaaacttatctacaaagaaccacagacgagaaatttgcctagagaccagctactggaactaaaaacaaatttcttattcaggaaaatgtgaatgagtaagaatctgctagtgaagtttcttactttgcacaaaaaattaaatgaaatcttaactttaagagtagcataggctgggcacggtggctcagcctgtaatcccaacactttgggaggctgaggcaggaggactgcctgaactcatgagttccagaccagcctgggcaacatggcgaaaccctgtctctactaacaatacaaaaaattagccgggtatggtggtgtgcacctgtagtccctgctactcaggaggctgaagcacaagaatcgcttgaacccaggaggcggacgttgcagtgagccaagatcgcaccactgcactccagcctgcgcaacagagcaagactctgtctcaagaaataaaaattaaaaaaaaaagagtggcatagttaaaagggtagaaggttactcaatgacgcatcacgtatagtacacatatagcacactgataataacaaatggcatgtaagcactgtggattgacttcagaagacttttccataagcttcagtatcacaaacgaagggaaaagcctgtgttatgtgcaacctgtcatgatcaaatagtgtgaatatgtccttgtaaaggttaattctatagcaatacatttagttgatgtgctttcttcctctgggattctagcactttaagaatgccgttcttcaaaataatcaattgtattattctcaagaaacatgcaaaataagaaatttgtcatcaagctggaattatctttaaatagaggatattcaaatagcatttttatgcctggagttgtcgcagcatgattccggcaaaagccgcactatttgttagctggcacacagagttttggcctgaaattcagtattttattttaccctttaaaagcatgaagtgactcaacaggaaattatacatacatttttccctccaatgtaaaaactgcagatctagtaccgaacatgtcacgctggcattcaattttctattgctatcatatctggttccttagtgacataaggtcacaaaacttctactcctgtggccaagagacataatagatgttgcggttgctcattatattaaatttgaattcctaagctaaacattctagacctgcactattcggcatggtggccactagccacatgtgactatggagcccttgaaatgtgaccagcccagatggagacgtgctgtaaatatacactacacaatggattttgaagatttcatatagaaaaaaaataaagtcaaatatctcatccatattttacactgattacatttgaaatggtagtattttcagcatgtgttacataaattacattattaaaattaattccacctgtccctgtcttttttaatttggctactggaagatttaaaactacccttgaagttcatgttctatttcctttgcccagcactgccaggaccttacacggactctgcctccacgtcactcgctcccttccggtcacttccataacaggcccgccactctgaccaagataactacacacagcagagtcccatgggtggatctcagcatccgcctgcctggttctgatgctgccctggttcccactactgtgtgactccaggcaaggtgctcagcactcctgagcctcactgctattctggaaaatgaggacaattagagcacctcctgcaaagagccacagtgaagacagtcctggcaaagtgtctcctgtggctataccatctggtgagtgaatgtcacctgccaccttccacaacatcacacctctcccttcccttatgtaagactgctttcttccctacctcttaactttacacctgagatattgaagtaggtgtctggtctgatccctccaacactccagaggatttggtcagtttccacactgtgtgacccactcccaggtaacacttccaccctccaaacacaccagcaggcctgactcctccaccctcccgcccactgctatctctaccattcccgccaatccagatccaacacgccatggcacagctcaagggcctcagcctccgggtagcatgctctgatcctctgatcttcctatggaatggtgtagattgcttttggattgcatgattctattttatgttatttatactctaccttgttcccaaaaagggactcaaagtggtctacaaggatatatgcaatatgacaaggttgtttaaaattcagaagcaaaataaaaaataaagatgaagctaaagagaaacaagggtaagaacataaactcgagctaggaatgcaatggcccgccaggcaggcctcagggtctcacatatctgctggagttgggtcattcacacgtctccaaataatgaaatccaaccaaatgctcagacaatgactcctgatgctaaggctaaaaatgaaatcctccaatgattccataagaaagaaggacctgtgtgatagcaagcatgcccaagaacggccctacagcaaacccagtgtattgcacgaggctgtctccctgctcgggaacatctcctccattgccatacagtctagagccctgttcactgccatgctggcccagttcaaccaggtggtcccactgaggatgccactcttgttggtgtgtgaactcatctccttcgagatttcatgatgtgcacattcacccccgttctagatttcatgacacaagcattcaccccttttctagattctatggcaagtatgttcacccactttccagattgcacggcattcgcattcaccgcctagattctagattccacggcatgcacattcgcccactttctagattccacgatgtgaatgttcccctcctttctagactctgtggtgtgaatgtctgccccaattccatggcattcttgctcacctccctttctagattccatagcatgcggattcatcctctttctggattttgcctccctgaaggcactgtgcaagtcttctgcatagtgtcttgcatgaagtcttacacagaacataaggcaaaaacatggactaaatggacagcttgccttccaccacacagtctgtagcttctagcctcccttcctttgcacgtgcctttcccaggatccggagcaccccctctgtggatggagtcctgtatcttctcaccttgagtcaaatctgactgcccgctgatctctgcctactcagcattccctgaattctcaggcattccacttgtcctgtattaatttccacctgtaggtatttatcctaaggacaccgcatttagagtgtccttgcaagaggggatgctcctctcttcagctaaacttagctatttaaagtaaaaagggtggtagttttgtttacctgttaacacaactcatggaagagagaaaaattcaagcatgccactaattgctgcagtcagacagacaggtggataggcgggctccatagcggaatgttctggcttctcccactaaatttgcagttgttcgtctaatctctagacgtgtcccgtgtcttaacagtccctgtatgacttatgctcccacctcttgtttgggacagtgctctcatttaatagatgctcaatatattttaattaagaaatgtattttcacgttgcttaagacccataaagaacaattaatacaatgtaatgcttaattttgcaaagaaaaagtttatattgatgctaaatgcatttacaaatgtgctcgtaatgtacaaacaaatacagcccttactgtgggttacacatacttatgaaatgattttattgacttacctttggttttacaatttggctatggggtacttagaagaaactgcccttgtgggacattctgtctaatcacttatatttacaagccttagaaaactgtaaaaatatattcagtttcattaagagatattcgatcttcagaactgatactatttcatctataaaatccttttactggctgggcgcagtggctcacgcctgtaatcccagcactttggaaggacgaggcgggcagatcacctgaggtcaggagtttgagaccagcctggccaatgtggcgaaatcctgtctctactacaaaaattacccaggcctgttggcaggtgcctgtaatcccagctactcgggaggctgaggcaggagaatcatttgcacccaggcggtggaggctgcagtgagccaagaatgtgccattgcactccagcctgggcaacagagcaaggctccatctctaaataaataaatacataaataaaatccttttactttgatacctcaagtagtaatcaataatatccctctctgttctaatggcagggcctttaggtaaggtttcagaatttgggataaatactaataatatgctgatctaacatctcttctccagaagactccctagatttgatttttactgtcattatttctattttaaaactctgtagtgaagtaagttttactgtcggggtcaaatagactagaaagtacttttcaatactgaagaagcaaatttttcctccacttttgcttattctgtcctcttgctgctgtatcttgaactgcagaaaaagcaagccttgcacaaggcaagtttaaactttgtgcaattatagacccagatttgtaaatctggcagcaggctcacatcagctttgtgaggttgggtataattttaatgagaatccattcaacatatgaaatcttagaatgtttctcaattagcacttggtttcttttcaaaatgtttttacctcatttcctaataaaagaaatctcagctttctgatacatttaattaaaaagttttatgttgagattgtaaatgtgagtggtttctgtttcaaaacatttcattttgctagtacatccttcacttattatttatactctgcttagatctctgcatttcccatgcaaaaatcctgaaatgcaccttcttcagtgctgaggtctaaagtttccccttcctaagtagtgccacagtcaccccctcttcctcccacagggccctcataatagcttctttcagtccttcctctgaaccctgagacccccgttcactctcatgtcaagcagaattccaagccttcattgcacacagaggtgggtccagggaggtatcccgtgtttctgaaattcctgctttgcctgtgcctaagcttcccaattctcccaagagtcctcattttaagaacacaatgcaatgctagcattgcactagcattcagcatctcccaccatacattgcaaatggataattagcttgattgctaggagattcacctgctatcccctcttctcaccctttagcaatgtgtgtggaacgcacttggctccgaacaaattaattgtgtgtgaggggtgacatctgactacgaacaactaaaaagaaccatttaatcaggccaaattcccttcaggcttattgaggcttgagtgtggatttttaaaatgtaagcagcactgtcactgtaaccatgaaactgtcatggttttaagaagtgaagttttgggggacaacaacatgaccaacagactctacctcagcatccagttcccagattagttaatacaaacttgggccccacttttcaacagaagcacagctctaagtaaaggctggtacccagctctgccccctcaaattatttggtgaacaggccaaatgggaggaattgcaggtagtactgcagaatctgcctgccttggaaaacaggctttccatgaaatacagttttaaggtccccagaggccagggctctctccctcccctactcttcaccgcgccccccgccaacccacacgtgatgagaaaccactgcccctgcagaggccccagcagcaggcaagggtctgtggaagaaagagaggaatattacaaaggggtttctggctggaggggggttccagggagggcagagaggttcaggctccaaagctggcagcagcccctacagatggaaagctccagtgacaggacccatgaaaggacactgcagagcttgtcccatgtcattgggccatcgagacatcaagggctgcctggatttcaggaactcacatctgtagaccaagaaggaacagcacgttcccattgccaatttcaatcaatttattaaactaaggcaataggtaagtaacagatttactaagatattgggattctcttactgtccatcttagttcagatggagattcacaacaccagctaatctgattccaggatgcagcttctgacggtgcacaagctaatatttccttaagatagtcacacaaacctccctgccaggcgtgcagaaaaatgtgcacgctccaatttagtctttcttttactttccaactttaagtactttagtgagccccaagaatgcatagccactctttccacccagttagagagaaaattaatctttctaccaataacagagaatcacttaatggaaataggacgatagtacttcactaaataaggcttcgctcctttgctcccctactctcaaaactgaggttcaaatgcatttctacactttcaaatgaacatgtgggaacttttgctgaatgctgacatcaagtgaaaataagggtttcctattttttaaaagtcattctatatatgcctgttttctttcctatttcctagagagacagcttttcccccccgagtatgttttgcaggggtaataattactgcaataatgttatccttaaaagggagcacatataagacaaaagcaggtacaaaaatctcattcccactaaaacaattcaaaatcataggttaggctttaaaaggaagcaactacaaatctaggttttaaaaacctttagacacactaaagatttgtcccagatcacatctgatgtctatttctctgggataataacaaaaaaaaagaggtgataaattaattcaaatggcctattttacatacttgaaggatatttccattgtctcatatagccattctgaataggacagagtcacataatgaaacttcctttgcacattctcctgaacacgcactgagtcaagatagccaaaccccttactttcattgtaaaattactgtttctcatacgcaatcagggtctcccagattatgacatgcgaccctaaaaataggagaacttaaaagttagtttaaatctaaaacttagatccagcgctccatttttagatgcaccctttaatttcttggttttgtctacattttacttatacttaaatttagcaaagtaattttagctcaccctccttcactaccttcactagactttgcaatgttacaaacatgaagcattcaagcctctttctaatatgaaaatgttttaaataaaagataaagttaaaagggaaagatgccccttttaactttaacttttaacttttttagctatgttgaagaactggtttgggtgacagcccagccattggaaaagccattggaaaactcccgctgttgtttatttacaaaataactgctttcaatcaatcattgtgagaggtccgtacactgacaatgcataatggacaactaattaactgacccctaataagagtgtgggaaataccagggagaatgctatcatgcaaggaacagcaacaatatggaggggtggctggtcactgccaagcatgagcatccccaaataccgcagtgattttcagagttttcaaaaagccctactcacaccactgccactaagtaccataatcatcggaaactgtgccccaaagatctgaacgtccctgttacatcagcctatttttcttacaaatgttgctgctaaggttcaaattcaaggtgtagaacattaaacaatagctgtattgtgaaggaccatgctccctgggaaagcccaagtaaccttacacactggggaaggaaaaaagaactcctttgccatactcctgctctctggaaaactgctcagacgcaaggggtaaagaagcaaagaggtgacaaaaagagacctgcattcagagagatcagctgtcaacttaaactgagaagtgacctgatgcctcacagagctgggattttgccaccttgaccaaactgcttcccaggctccataagtctcattagaaacgtaggtggctctgtgtcgacaccttctcaatggagttctatgaaataacaggcatcagacatttattcactatgacaatgtcttcccaccactccagatcctatgaccgggactgacttgctatcggtttttgcctgggaataggaaacgattccagaaacattagctcttctgttttgagaagaaataaattcccccttttatttcttttttgtttaaagatagcaagataaaaataaaaactaatattacttttagaaaaaaaaagtgttgaaagtttcctattaccctacttacaatgtgagatgcatttaaaagatacataacgtataacattgtagaatagtatgtgagttacacattccttctgacgtctttcagagatgctttccttcttacttatgtatctggtattccattgggatcttaggtcttaccacaaataaaatatctgattttataagattaaaaactcaacaaggtttttctttaatataaaagcaaaacgtggaacgtggaggggggaatgtttatatacaggtgtgaatgcagcccctcacacaatcccttcaatggtaaatgctaattttctaaattttagctaaagattaaatcaccaataattcctcatgaaataacagataaacgtgaaatcatgtactacaattctactctaaatttttttaaatagaatgaagtaattataaaatgttacaaaagagaagaaactggaattataagtgctactggaattatatattccttaacaaatatcttgagacggattacccatttgctaattcagtgtactttccaaaagccattgacccaaaccgaagctaggattaccaaatggcaaatagcatttgtgatgtgtgtagctcttctaaagcctttcttgagaattgtaaaacttgatatattagccacaagtttacatagctcaccgtttctgctagaattataatttcaatggtgtaattagcttattaataatttgacacatggtgaattaatttacatggttgggttcttcgcaacgtctgttgcctgatcctcctgtggatgaaggctatgagctctggcctgccccgggagcgggcaccagccaatgccagcggagcaagggttaactttgggactgtgacagttctcccttcaggggctctaaactacttggagagaatggaaaacagtcaaaaatagtcccaaaggtaaataaactctgtgtcctatgtatgtcacccagggaagaataaaatgtatttttactcacattgaaagttttctgaactacaaaagctatagagacatgtacagagtgaaacctgtagcacatacgaatatgttattttgaaagataaaggaaactatctttagattaacgatgagttgtattaaatccacatcctcattgaaattgtttatccattttattgcgcagtgtagtctgctattaataacagaatttgtcctgtacttaaaagataattaatgcctctatgcatctatgcaacataccatagcaataaacggacgatgtatttcagacagaaaccaggtaaggctagctgataaaatacagactatattttttttaacatgccaagttttgcaattagggtggtaaactggaggcaaataaacttaacagctgcaggctgaagaatggaaaggtgaaaagactgagactgagagtgggaaaggaaagggaccgctcctggcgctgagagctggtcccagagccggtgttgcggggtgtgcgggaaggcgccgtcgggggtcattccaccatcaggacccagcggacagtgacaacccagcctcaaacctggtccctactttaggccaagcgtcagcttttttagttcaaccctgatttccactccagacaaggacaaataacctcttggtcggggccccagatgaagtccccgcggtgtgctctcctggcccttgtcaatttcggggtgccccctcctctccatccgcacccgactgcacgcgcctccctgggaccccgcactggcgagccgtccctcccggcgctggacgccccacctgtcccggcgccgtcggaagagccctgcagagtgagcccctagggccaccccgctgccttcctccccgtccccgcagccgctgtagccagcgtgggagccgggcaggtcgcgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccgagccgggtcgcactaactccctcggcgccgacgggctcagcccatggtgtgggcgccgggttcagggaggctccggctcccgccaatcgcggagcagggcggccgccccgacgcgcgacttgcgaacccggagtgcgcgccgggggcggggcagggacgcgtgggcgggaatgcacgcgcgtggccaggtgcgcgtgggtgcgagcgcgcgggagtcttcgagtgcgcgcgtgtccgtgtgcgcgtgggtgtgggtgtgctcgcgtgtccgtgcgcgcgccctcggggccaagagcgcgggccgcgcgggcaggtttggacactacgcgccctgctcgggtttaggacgcggctggcggctccgggaggaagaggaggaggaagaggaggaggcggaggaggaggaagaggaggagggaggcggaggagcagaggctgggacggccggaggagagagtccggccccagcaggaaaggaacccagcacgcgactactggaggggcgaggagcaagggaaggaccagaggggaggagagggggtcaggggagggaaagtgtgggagggggagccgcgggggtgcgcgctcctcctaactcggggtcgcttttagcgagaagtgatatttttccagcctcattgaaaaccgttgcaaacattgaaaatagtaaaagtgaaaacggttgcgacactaagacgtttataaaatgaccgcggactgccctcgatgctgatgagaactgggacgacgtcgcgcagagcgtccggagggagaggcgcggtgcccgggacctcggtcgtggggaggagccggatacagccgccgggacgcggggatgccgagggcaccgcggcctggtctgaccgacgcacgcggtgacagccgcccttgggagacgacggcgtctgcaaccagcagcctccaaagggtgcagccaggaggctcagcttgtccgcctccggggctcggggctaagccccttccagaagttttcgtttctacgcgaattccgaccgcaaaatccagcttacctgagcgccgctcctcttctctcatgtccctcggggg

SEQ ID NO: 2625 - DNA, 280643 bp, Homo sapiens
tttggtgtatttttgagtagtccaaagtaatttttattctctaattagtcacctcacgactttatttgaatgaattaatgagaagctaaataaactagctttttaaaaaatattttcttctctttctccaggcaatgggtcactttggggcgctgcagaacatctgtgctttccctgtgccccatcaccttcccagctcctgagctgtagccatctctgctgcacctgctgtcagagggcagctcctccggctcctgctcctgggttgcaggtgccacatctgtgcagaaggcttaggagaagcagtgagccttctaactgcagcagtcctgacaaagcactttgtgaacccctccgggacataagggcatcaaactaggaacaaaaacacagtcttgactgtgatttggtgattttaccacatacaaggcccgaaagccaattgaagacaagaaaagaagacaaatctcttgccagcaggagtaagattgtacaggagtctgagtatacatcagggcaagccaagagacagggacaaacagagagaaaaggttcatgcaattatgaatatgacctggagggggctttggaattagattacaacagtaacagagagttaatgccattttgaaacaatttaagaattatgtatttgaaggaactcagtattatcatgttatccaaaattatcccagttgctcataagacttgctaataacctggactgggggtggagggttgagggatctaatggaaaacatctgttaaaattgaatatgataatcatgtcttgtttttatgatcttgctcatgagacagtcttgaagagagaactgagtgattatccaagtaaatgtgtatttctatgaagaatgtaggtgtgtcttgactttgcattccaaaataaaaatgactgatcttttccattagcacagtttgggtcagcctaactgccagctttcatgattgtatttatttattttccctaaggagatacgggcactttgtgggccttcccaggctgctgcaaaatgatggatggttgggctccgtctaatccaaatgacacggggtgtcaggagcattggtaatcgtgtcctgccgacttcaaagcccactgccaaaacatccacagcacagaggtttggcaacttcacataatcatagcaaaaggactgcaacgtgaaaaaaacaggccctgaaacagctatgaaaagggccagttcagaaacctattcagctaagatgtttcggctagcgccttcgcacggtcaccttgtattttcaccttttgagttgccttcacctggaccaaggttggcagcatttgtgattcaaagaaaagatgcccagggaaactgactctagattatggaaataaacattgtcttcaagggatagccagcaacatcaggctcagggctagtgaatcccaagccacagtgcccaggtaactctgatgtagcaggactaaagctgtctacctagtgagagctcctgaaagagaaaccccgcagcaaatctagacgttatcccttgtttctgtaaagtgagaaattgcagctatccatgacgctttatttgccagtaataatacagtttgccttacgagtggtagcttgttcactgttcaacaaatgtattttaatcatagcaggaattaagggtgatttgtgaccaggtgctgaactagaatttctcaatgacaaccccagcttcataggcctctttccattccaggcataaatatggaggctccaatgtgaaacccggggtccttctgttccaaaaggggctagaaataaaagacaggaggggaggcaagaaggacctggagaggctgacgccatttgggtgccaaacatcctatttccttggctctcccttgcacaagttcctggacaaagtaaattataacacaaaatccacaacattcagcacatgttttcattaagcaactttagtcactaaaaaaagtgcaaatgcagactcctgtataaatctgatttgccatgctaggccaagcttattttattacatacattctgcattctaagaactaataacttcatattgtaaacattaagcatacagagttaaaattcaaggccacattatatcgattgtctcttttgtcgtgtgtctttggctggccgagatcaactcgtagtgtataaatgcataagttatataattattatataaaaagggggaaaaacattgacttgtatacttcattctgacaaacgcacagcgttcgcgactcaaaggaaaactggaggccgcctacccaaaatgcctgcgtgatttctgattgtggcagccaagaaggccatctcttacctgaccctgtggagaacaaagcccccacataatgatgaggtcctgaatgtttctcttaaatatcagacaattccagttaaaattttcatttgacaaacaaagaaagagatgcgcatttttgtttctgaattctactacttcccctttctccattacgctgtgtcctttctcctaacactgggtttggtataacactgactgcatgaaccctcgagtctccataactcattgtacacagtccccaaatgtcctgagtccagtcttcattgcttgagaagtttctttcccagccctggtctcctccttctctgcctcttcctcctccttcttcacccctctgtctacaatcacacgctcactctatacacatcctcagtcccaccttttagttcatagtcccggtaatactgtaaaggagttggaaactttgggtcatcttcacagtttgagaaagctgacagctgtccatcaaacggaatgtatttgatttcaaccaaaacagcacatgccatgcagttgcatatcaacgtctgttgatgggccacagtctctctcgtgtcttttctcttgtttttgatatgtttctatttttaaatacaggtagttttccttaaaatggcattataaacggtatgttaggtcaaaactgtgttgtttctattgctttagtttcatcccagtttgcattagtgggattccaaactctactctaaagtttatacatttcttaagaccactttctttggcactttgtccttaagacttcatgcttctacatacactgtcttttacaaggtcagtccacagatgatatgtccatattcgtgacatttttagcatcctcctcatttctgtagtaagacttcagtaactccctcccaagagtctttggatctcttccccggcttccttccccagccccagtaaagcttttttcattcctcttgaggcacttttgattcatgttctccgatagagtttgtggcgatgggctggtgaatgcacgctgatgggaaaagcctccgccaggtctttagtagtaagtgcccagatgagaaggcatatggctggtggggagcctagtgttggggtatatacccccagttggtgaattccagtatgggtttggggcagcaaaaaaactggaagatgtcacggggagggctggagggtggggcgccacaaagttcatcttctgtgggtgggcgtgataggagcccatgtacgggaggtctgaggggtacttgtacagagatgactccggggggtggggctggagggcctgggcgatcccgtggaagtcgaacttgtaggcgtagcgcttcccatggaccttggtcatgatgttcttgtcatagtagtaacggagggcgcggctgagcttatcgtagttcatgttgggtttgctcttccgctctccccagcgccgggccacctcgtcgggatccgtcatcttgaactccccgttggtgccttcccaggtgatgcagctggagttggagctgtccgacaggagctccaggaggaactgccaaagctggatctggccactgcctaatgaggtcaggagaggaaggaaaactccagtgagcacaggttccaggggaaagaggctctctgtgatgacggaaggaggtgctattggtgtgccgcccacattcccttcaccaggcctgtccgtccatccctcagctgcaggggtgcggactgctctcgttccatggccacccacttctccagagaactgcccttgcctgaacagagccgccgcctcgcccacccccaggtatcccacagctgggtggactgaacggggtaccacgggccggcccccttgcctcaaggaaagaccaactccatgacgctattcaggcttcagggctcccgtgggattgggctgaaacagcgtccagctgcaaggaggcttggaggaggccagaaacttccttagcgctgcccctgcagcacttcccattctctctctcctgagaacatgccgttaatcagtcacctgcacaagcaggcttaccccaagctctgcatcaagggaacccgacctaggacgatgatctaacagattcaagacctagatggaatgcagcgaattcatatggggcaaagttcaggctgcttccatccatttctgacgtccttaaaagaacagccagatcaacctggtgtttaggggatgaaagagctatatatttttttttcctattttgtgaagcacaaagtactgttatgtggatggcaataatgacttaatgccatttatattggctaggtcaagtaagataataaaagttagatttaggaaatgaacttctaaaagtttatggaaaaaaatcgagaatggaagtaaacaccattatttctaacataacattttgctggcgctcagaaagcaattctgtgaaaacttttcctagaacagaattaacccactcaaaatgaggaagtttaggaaaaaaaaaaaaaaagctggctctttttcaaaccagatcacccagttccagtatttgggcaagcgcatcgtaacggaaaccagtgccttgcctgtgtgctgcaacgccaattgtgttaagcagcatttccagaagaaaaaccccaacaatgagtgattgcaagtccccttgggaagctgaatgagactcttcctttgtcaaagagatcacatttagctgggtggacaaagtcagaattttcttgatttcattgaaatcatacagatacagctttgttttatgaaattcaaagaaaaatctaggcacatcattctagctgctatgttacaatacttgaagatagtttatggctccctagaagacagcagcatgtaaatattgacagcagtatccgtaccaagagaagctaagctgtgctgaacatatttcagaagcttaagaacagatgggaggtgggtctttcctcccaaattccagttacagcactgccttagacttattaccaaaagattaccttttattatagtgtaagtaatatcaatcgatgtgataaaatgattaaagtaactttaactgacatctactcagggaagtaatatactgtaaaaatcaattttacgttcattttcttctaaatcctcgctagcctcctgtacatatcacccaacttataaactctgctttgcatgttggctacatggacatggatatttttgtgaatttatccatacaatagcactgtgagaaaggtcagctttttctgaatctatgctggaaagtgctcattttcagtctagcaacacatttgaaatgtattaacagcttgtagctcattgaagtggaagcctttgctttttcagaaccacatatacaaactgttcccaatcaagttttgttgcctccaacattttattaatatgcatttagaaaatacaaagaatggtatgagaaaaccatatggtcttagtatatatattgtaaccaaaaaattacaacttgaaaaaattccgtatatgacctgggaataggaaaaggcatggatttttgatttaacagtctaacagatgcttcaatataaacacatacggttgtttgaaaataaatattcagcgtcaactttctcccatagagaaagcaactccacagacctgccgaaatcacacttggaatctactcaaaccttggcattgcctcttagcaatttgtccctcacccatttctcttataaacgtgtgtaggacagaatcagtggacaaaagtgatctcatgtctctcctatttctgaagagttagaaagcaggggacctaaatttgtggcagcaaactctatgcccaaaggatggatgagctaatttctcacttgactattttacccagtagccataaagacatagggctcaggactgtgagaatttcaagggagggtctatagaaataagagaactgtaagcaaaattcatcagctttcaaaccttgaaagaaacctggaaatgcaaaatcaatgaatgtttaagtaaatggtagaaagagtaacatcatgtcaaactcattaattgttaaatttaatatttgtaacaaaattcgctgcattttgcagtgtgtagaacaaaatttctcactgcaagaattctcaaaaatgaacaatggttgttaaaaaattgtcagtggtaaaggaattattctcagtcataaaattttaagagcaatttttaaattcttattttacttccaaaacaataacatttaatgtgtgacgaggtgcattttagaatatagaatagagatttccaaacaagaatgcttagggtttaggaaagcctaaaagtggcttgggtcactcatgggccaaaccaggatttacaaagagaagttcttgaaagacaagagctttcattgagtagcatcaccacctctaccttaggactcacctttcttgggtaaacccttcagatctattttttttttttactctctcttaataacatccttgcgatgtcagtaaggaggaactaattttttcttagggtaattaccaaaataaaacatatttggaggtaaaaaacagtggcaagcagcattgtccacctacagagaaccctgtgggtgaaagggagcggctgtggcttttaagaagacagaggcactcctttaattttacagaggaaagtaatctcctaatattgttaaaagaaagggagagaaacagggtagcaaaggggtacagactgagcaaaaaagggggaaaaaaaaactaaacggtttacaaaccacagagcaaagcagagagctgcagagtgagtcagcagctgtgtctggtggaaacagcatcctggtgcaaagccctgcagccgtcagctgatgaacaagggcagtaaatacagccgtgaggggccccaccagtaccatgtggcagtggtttggggccactttctctagaagccaggggtggtgcagaagatcccgtgtgcatggcctggaccctctgcaaggcagcaggtgtgtccagcaggtgtgtcctgaatggaagtctctgccccgaggctcagtgaggctcaggcaccacttactggaggggcaggaaagcatggtggtagggagcaccaactttggagttgccactgcttcagctgaatcctgcctctgccctttgtgggacgtttggcaactctcgcagctctctctgcctcagtatcgtcatctgtaaagtgggggtgatggtaatagtactatcttgcaagatcatggtaaggatgaactcagtacttgaatggtcttgtcagaatttctttgggctgaaaatcagagtttaaggaaagataacactcctctcctatagccaggaaatgcctaaagaaagagaaatactgttcaattggcctattgaaccatgaagaagcttgaaacggtgctattcttgggctgactgatatcctctgaaagcttactgtgtgccatgcaccattctaaacgctttacatgtattggtttatttaatccccacaggaatcatgtgattagtccattggagaagtgacgaaattggagcttagagaggtagactgacttattttgcttagcgttggcaagggttgaaatccagactctaggctgccatgcttaatcactgcgcaaacttgctttcaggcctggtttatgcacacctctgtagcctcctcaggtcctttccatgttgtcccctccctgggggactcccactggaagactgcacactgccacctcctaacaaatgggaaaacatccctagcctggtctgtcgttctgcaagaggcaggatgtattttcatgtgcaccattgaagagtatccagttagcatcaaggaagcctctgaacataacccaccaaagctctttcattagaggaaccatgttagatagattctcagctgctctgatgggatgtaaaggagctgtgttgcttataaccgatccatgatatcagaatgcagggacacactgttctcagcaggaaaagtgatgtccaaagtacacatcaagtgaatatttgggatagagatgttgggatgctgacatcatcctgtgcattcatactatatgatgcaatctttccacttaaaatgatgaaaaggaatttgtattgtatgaagagcaaagacagcaatttttaagtgatgaaagatttatttatcagagaatagaaaaatagaatcaaacaggaagaagcattgtcattaatacaaagataaaagacattctggtttcaggggaaaagttcacatgagcacaacagacacaaacctaaagatagatggagagaaagtcaaattcatcagaaactaaatgaaataaatctttatcttaaagtcacttgcctgcaaatcaaagatgggatgttgccattttctccaggcccattaagaacagtcttaatggtatgaagcacagtcctccttccccaggcctgtgatgagtttccggtctccttgctctgagctcaggtccctctatctacaaagggcatccccgggctgctgggcccagggcatatgcagtgttcccttgtgaaagctggcactttgcttaggagcaagtgactcaggccctattctacaaacaagccaagcagtacctttgggctgtgacaacgtggtcatggacatatatgtttcatttggccaatgtgtgagtgcaaaggccagtttggtcttctttggtgcagcttgactctttcctcctcttccttcctgacctcagattcatcgcctgcacctaagcagttatgaccctgaaaggaaatccttgctttctattctcacagtccgcattttgtaagacctcctcttcccttcatacttagtcagtggcagagtagggcaagaaaacaaaagtagactttgcagacagagtcaggtttctaacctgacctcccttatcattggctgtgtgacacaggaaaagttacttaacttctctggacttctaattccttttctgtaggatggagatagtaacctcccagggctgttatgagacacagaagggaccacagacattctatggggggcattctgcgggatgggagctgtttgattgttatttcacatgattgtattaacattcccagagtgtttcagcttccgtcattttcttttttctaatctatcctgaacattgctgccagatcagtcttcctgaagcatgactgataataatcatctcaaaacatagtcattatttttatttgaatggttatatggcagagttgcaaatgaaaagctgagcagaaggctgagaagagaccacagcctcaggagcctgggctactagatgaaagccagcatgagcaaaaagggcctgtggctctgtgtttgggacaatgttgtaactacctgtgtccatctctccacggaccaaaagcaccctgagctaaaggactatatctcattatccttggcattcatgtatgcaacaaataattattgagcacctagtctaggccccaggctaactagttttctttagattttcagctgtgtaaaaaaaattcattgaattcattaacattaaccaaaatttaacttcaaaaatacagatgttcaataatgataacatttcgtgttttcaatgtgtagattctcttgcagggatgtacactgattaaatcttaattattccatttcgaaccttattttggcctcaacgtttaggaaatacacattccatcttgtgcttgcaatatgcctgtaacatcttggcatttgaatttgcagttgggaatatgcagcataggctatgaatttctgaagctggtgccagcacagctggttctgatctgaatacaaacaaataaaactatgtggttggcactgaaacactaggacaggtgacaaaccttggcaatgcactggttacaaatgggctaattaagaatctgcactttcttctagcatcgaagttcagaaacagaccatcgaagatgagcctgaatttgaagtcttgtggttgtatcaaggctctcttttaaaaaatactagttattttatctgcttgtataatgggttgaattgtgttccctcaattccctatgttgaaatcttaacccgcagtatctaagaatgtgaccttttttggagataagatcctaaatgaggtaatcaagttatagtaaggttatggggtaggtattccaacctgaccaatgtccttatgcaaaagaggcatttggacacagagactgacacacacagagagatgatgatgagaagagacacgaggagatgatggctatctgtaagccagggagagcccccaggacagatccctccctcacagccctgagaaggaacgaaacctgccaccatgacactctgatttcagacttccagcctccagaactgcgagacaataaactgttgttgtttaagccacctaatccgtggtactttgttacagcagccctagaaaactattacagcttggattaggttataatgttctttgctgaagctgaaatcttaatttataacccaacccatctttccattaaggcaaataattcagtgagacctaaaactaaaatctgttcagttgaaggaatttctcaccaataccaatttacttttcaaaataaccactgccaaaaagtaattttgtaagaagaaaatcatcagcagtttctcacctggatttgcaaggcggctacttgttggtccaagaatctgataaggatctacagcaaaaagaaacaaagtcaaatcctagacatagttgtaacatagtatgatgtgacttcagacataatgcctgacttaattgttttttcagatttcagagccgaaaatgtcctccaactccaaatcaactgcctccacctcctctatgagagaagatgtcacacggcatctcagatgtcttgctaggggactcctaattggtggcagggcttggattcaaccccaggatcctgacatatagctcaaggctcacaccaaccaatgatataaagagggcaaacatgtgccaagccccatcaatccagggccgtgcaggctgtgttgtttaggcatggaaagtaaaatctaaaaaattaatggatcacaaagaagcagcctgtgtgcacgtagaatttttttccctatttattgcatagttggggacgtgttttagcaccatctcaagtcacctcgcatgagtaggctgatgacttgggccctatcttatgtatggagctgtcgaaaagaggcaaacaatcatgttaatttccattaaaaagtgaagcattttagaaatgtgctgctgagcctgaatcttctcttatggttatccagacggcccctgaaacatacctaactgaggacgctggtcttcagttttgggcactgtggaaggagatggttgagcagctgaaaatccagaaatacaaaaggcaattagctataacagatttggtcactagtctttgatgttgttgcataatcattctatcagttaatttagttattaacataatagtctaactcagaagcatctcacggtaaggaaaaattttcctttctgatgaaatcaaatgtaaacactgtaacaaaaaaagaggacatttccaattatttaaaaaatggatacctcccactttttccaaaagtaaaaaaaaaaaagaatttggaatggcttaccaaacagattacaataaatcatagtctaagataaacacataaagggaaaccaccagtcaaataaagtaaagccagggatacttttaagcatggccaagattcaggaaaacaccgattatttaatgtgtactcaaacatcccatgaaacatgcatttgtgaaggttgacatacactacatcattcctttatttttgttatgaaagtcctgatgacccaaatggagaaagaatcactgcagtgaaagatcaattgtactcttgtcgtcaatggaacaaacccatcacatgttgcaaaatcacagattaaccacagaaattattatatactccatcaacagtcatccactgcctgtgacatgaaactcagggtcatgggagccaacactgtacctttcgactggggcgtggggtggccgtgaccggtccaggctgatctcctggggggctcatatggtaaatctgtaaagacaaataaattgactaaaagatcaatcatgtaatttttataagagatgctttggttttttatttgattttgtatttattagaataaactttgtgcaaaaaaatctggtaatccaaagaaatatcccactagatttgagttttatttacaaattaaaatttcatatattatagtggtctaaaattctcacccgtttgtctgaaaacttccattggcagattctcccagagctttccaactcttctaatttcctacaaccataagtcaagaccccaataaaagtttcttacaatctagttcatcctgcttccactgggactgatctacatctgtctctttattatcttcatgactcatccaaagcagagtctacaacttggatgaaccagcccatttttgtttgaggtctgttcctaaatcaatcaaatgacattcagcttctttttcttcttgcatctcctgggaagtgatcgctgccttatctttttatttgccagctgcctctcttagccaactcccattttccctttataatctcatcaatttatattaaatcagtcttatctgatctagtgattttcataggcaaatgtctcccatttctaatgttctaaataaatttagaatttctctaaaatgacctgcatgaaatgaattacaggactgaaatagtattgctcccacagcccattaatgatgaccttctgagcttaagcatatgccaaacatttctttgtatttataaagtcgtatcacttgtcctataaaccttcatttacttttcatatgcaaatttaataactatacttctgcatcctcagtgtgagttctattaatgattatcaaagctctatgtcatttcaagtttgtttcaaaaatatattacagaaaccttattataatactcttgctaagagtgcatagctaaggctatttctacatgcaatcttattacataactgtttcaaaattatgtcttcttggattgcttggtctcagttcaatgtcatgtgtcattctgggccaagtgaaggccatggccaaatatctcagcaggtactttgctgccagacaccaggagatgtgtacaaaatttcacttggagggtaggacaatgcaattgtttttaagcttctctttaaacaaatattttaattttgtttaaaaccagcaatttgatgggtcaatcttcaaagagcttgactgtgttgcagaagatgtgtctcttcctattttcatatcccaaagagaatagaaatgatgcgcaacgtgaaagtcaacacagaatctccttaatgtatttggtctgtttggctgcaagcatctttgctactagtgtggtctatgaaatcctacccttcagagctttggagaattagataatttttctttttaaactgatgttactcctctctctcagctggcatttttgcatttttggacgtaaatcttttcccacccagatcctcagattttcacatctcttgtgttggggttacacataggaattatatctgcagcccctaacaatttacaactgaacttcaacttaagtctctgggaacactctgcacatgggttctcagtcagttgcattttgtctaaaataaactggacagccagagtttcaatttgcaaattgtctcagaaagaaaaacctactcacaaggcaatcctagccacatctaacctaatttaggagcagaaaagcacattaactaaggccttctatttaccaaatgaaaaaaagcaagataatacagaaatacagaaatatgttctagatctctgtttctcaaagggtggtctgtggaccagcaacatcaacaatacctggtagcttgctagaaatgcagaatcttaccccagacctactgcatcaaaatcagcattttgtttattatctttttttttttttggaggtggagtctcgctctgtcccccaggctggagtgcagtggcgcgatctcggctcactgcaagctccacctcccaggttcacaccattctcctgcctcagcctcctgagtagctgggactacaggtgcctgccaccatgcctggctaatttttcgtatttttagtagagacagggtctcatgctgttagccaggatggtctcgctctcctgaccccgtgatccgcccgcctcagcctcctaaagtgctgggattacaggcgtgagccaccgcgcctggcctcagaatcagcattttaacaagatcctgggtgactctggtgcacactgaagtctgagaaagcctgctctagaccattgctcttttcaggaactctgttcctgcagatgatttcagaaatgctatctagagtgtgcaaagacaaactaaaaaatggttgaaagagttctagatggattgcttttacccatggcataagtatgctaatggaatgaatagacagcatcagtaggttagtcagatactaccttaaacataaaattgttgctcatgaaatgtgactgggaaaaaaaataaatgccgaactactattcccaaaatattttgaaactctttattcacaaaatccttcatatggtgtataaccatatcccatcctccctcgaaaataagtcgaaacttaacaccaaacagtctacttttcagccaagtatttgagacagttatatgaacaatgattcacatgttcataaacatattgccgcggaagataagtgggcttttgttttcttccatgacattctggtccaatgcttccttatcggctaccgatcacatgctgtgggcactaagtatccccctgtgggatatgacattgggaaacattcaactcaggctcactgagatgggggacagccaggggtgacttctttggcagctacaccatctcaaaaccttcgtagttctgctcttgactgcttgaaaaatcactcctctatgtatctttgctatgtgtcctttattgataatagagcatcagacttccaataagaatatattttacatttaattttcgctgatcatttcaacaccctctccatttctctttgactttgatcttcaaggcaatgaactcatatgcttggcagaagtgcccatgtaagggaaggctgctttctggcactggttctgttgttttatctgtaagagactgtgtttaaaaactgagctttatagaagtcattgcataggcagcttgggtgaacacagatgtacattacatcacaacagtataaaaaacagcatgaagctacaaatagggactcggctagtgctgaccactacacaccagcaactgtgtcgatttcctgggagctgggatcagcttctcattctgaatgagactcctcctccaccacacccttttgaagacatcactaaattaatacaacattctggctaccctttcctggagggctaagttcagccaagttttacattctcccttcatcaaactcactgaggaggaacgctctagctcttgccccacacaccccacaccgccaccccgctgcctacccgctttattttttaaagggcaagaatgtggatcgtggaagagctcatcctcattctgcaggatccacaccatatctgcaaagcaactctggaggttccctggctgggctggatgggaacagatgagatttgcctgctcttgaaattagatgctaatggggaacacaaattaggaagagcaagagctgctgctaagaaccaatctagaagtgtctgtgaaatgaaaaaaaaagtttgagtcaaccttaacataattaagttgctctctattttcctccagatcttcttaaaattctacatcaaagtttgagcatggagttttggaaacattttgcattcccttcttgcctaggtttgcatatccctgtggttatataagaactaagcggaagcaaagaatgcaattttagccatttgctaagatacaggctttacataacacctaactgagagatgctatgcagtagttgtattgtctcactatgcctagctgtgctgaaaagcactaggctgtgagctccaatggaggaataatttaagattccaagaaacccctgaagagcagcagcttcaaagtagaagcaaaggctgcatttgcaggcttaactctctaatctcttttgataacaccccagaggcatatcataatatatgggttgtcatggggatggaagaggaaaggatggggttgcagaacatcatccttgggatagaactgagcttttgcatgacctgctcctaagaggacaggcagggtggtgcactgtgtagttaataggggcttgcaagattctgtggatctgtttttgccactttttcccctgagacctcaaagggctatggctccaaaagaagtggattcagcaaaaaagaagggtgtttgtagaggaggtacagaaagggattctggtcgtagtaactgcaacaacgtgagaaacacgtgaaacatcataaaataaagtataataaaatatatatatatttaaaaaatcataaaaccacagaatgtaaaatgatatgcctatgggttgatactttatgagagtagagaagactgtctcaatgctaattcaacaaaggggttgtgaaagaaggtaaatcttgaatcaggaaaacgtgggaaaatactaggtacgggcatgcaaggaaaagggatgaggtttggacaaatggcaggtagtggtggtggcagggcatgttcacatgtggtcccctgtgaggtcagtgaacggcctcggccaattgtgcagggagactgaactgacacagcagcagcgagactgacctgacagggaagcagtcagggggctctggaataaatgatccacttgggaaggtgggccatgaacagaagaaaaggtagattgggggctgggcatggtggttcacgcctgtaatcccagcactttgggaggcagaggtgggcggatcacgaggtcaagagatcaagaccatcctgaccaatatggtgaaaccctatctctactaaaaatacaaaaattagctgggcatgatggcatgcgcctgtagccccagctactcgggaggctgaggcagaagaatcacttgaactcgggaggcagaggttgtggtgagccgagattgcaccactgcacttcagcctggcaacagagtgagactccatctcaaaaaaaaaaaaaaaaaaaaaagaagagaaaagaagataaaagaaaagaaaaggtaggttggggcagtaacccagggatgggtgactcacagtgggaagggaaggagggaagggtggtgaggaagtgctgggaaggtggatgcagcaggacaacacacatgtgtaggagtctctgcagaaagggtgcggaatgctgtctaatttaaccagtaaaccctgaacaccactgtctcctctatcagggactctataatgaaacggccaccatgcagagaagagacagattctggtctaagtagagttgttacctaggagcctggcttgcttcatggtcagcacaataacgctgaccagagttcggttccctcggatgtgggattagacaaagggtatggaaatgaagatcatggcacagcaaaccaagagtggaggagacagggatttgggtctgtatccccaaggaccttcaaagaaacagtcaacaatcacctttctgaaagtagtcaggtacccactgaccacagggatatcgtcagattcccagtgacctccctctggagctcgttcagctctgaaagttagtgatgcaaaagctcttccccctcagccatcacgacgttcattctccagttgcaggttcacagcttttatctccacaggagcagtcctttaaggttgatcgcttagcaatggatgacccgaggtgtataactagttcttatctccaagttcaagtccctgaatagggcctacagtaaatagtcctctggcttgttcagtctgctttaaattctttacaggtcagataccaatatttgtattggttctcataatcacagtagcagtggtcaaaacaggttatttcaggtacaaactgagtcgcgaaaacatacttgactagtagtggagctgtggaagtgtgctctctcccaggtcacgctcaaattatgggcccatggaagaccaccatcagagcggcatgggaggtgtctgagtttgccacccttgccttccctgggttgggcagagagggagtcccaaccaacatcctcacagtcaccctcttctccatccacctggatgggccataccttccaaatccaccatatcctaaaatgtgaaaacaaagcagctccaggacccactgtcttaaccaggtagcatcagtcagctggcttgtctgacagagagattgtgccaatgaatttggccagtgttgtgatcttttaacacagtttataatactagctcacaacccctggctttgcaactcagtcagaggcacctatgagatgtcttaacataaacaaacaaatacaaaattaaaaagtaaaaaaatttttaaaaccctagccaaatgttttggaaatagtttttatttttttagtttatatggaaatattttttaaatgctcacagaattacaaaatctctaaagcttgagtcaaacatgaatttctattttccactcgcaatacacgtggtggatgtctttaggaccaatcttgcagactctaggcactgggtcttgcccatgtttcaatggcctgtgaaatcttttacatgacagagatgacttactacctcttagtaccccttagctgctaagcctttccatcatgcttcccaggagcaagacagtaaactttttctctgacgttagagaagagaaaattgccagcctgaagtcactaggcagtaaccagggcagtgtcagtatttgaacagcctgagaagcttcctcattcattctctttagctccctgggcccccagtctttctcattagaaagaaagagtagttgccaagcctagatcttgaaccagttcgaactgagacttgtgtattccggatatgtgatagagtttaacatgaattctggaagcatgtatgaatatggagaaaccatcccaccaccctgaacacaatgtcatcagctgtgaggctggtacaatgatacctagcttatcgggctgatgtaagtcccagggagaggacaaatgctaaaggcaagctatacccttctgggaaatgccctctctccctgctcattattcgtctggcaaacatctaattcccctttgccatgtggccattcctctggaaagcatctttatgcctttcatgggggattgagttcctccccacccctgctcctacgccctgtattgctagaagtggttcctctaccataaaatctatcacattagggaaaacatttatgtgtacatatgtgtctctctggctctaggtcactctactgaaacatctagaactggaggcaaaacatttcggtttgttcaccatcataccatccgtggctggcacagaggaggcactcagcaaatgaacaaaccaagctgaatgaagaagtaaactttctgaagacaggaagcttactgaagcctggttcatctatatattcccagagtctaacaccacgcttggcactaatgggcacttgatagatgtttatttttgcatgaatggcatgtaaatttattacctaattaaatcatttggaggacaggcagtaagattcagatgtaaatactactggttgcatgcttctgctctgcaagactggcttcttgtgacatactgataatcggtcactgtgaatctggggagtgtccttgttttgtgctcttcccccgaggagggacagatccttctgttagttcaaaagtcggcctattcctaactgccaggcatccaggatgccttctttgcccatctgtctttctgaaaagctagttaaagggctaatctgctcttaattcctttagtgtggtctttgaatgaaatggtttgagtggatttagtctccaaatcaacagaggcagaataagactgtctgggactggcttcagctccgggatcagctctctttgtatcacgtgacttagggcacggatctcagcaggacatctgggatgtctctcaatgaagagatcacacaggggtgttttcgtacctggcctagttgtaattctttgcgtagcttcaggatatactgaagtatttgggaaaataaaagctgcaccccctgcagacaaaaggaaagacaaacatgtgaaggtcttttgttgtggttgtcgatctcaacatcagcgccaaatctacttttccctatgacaacaaagggaagagacctcctcaaacctgccttaacagagctccggagaaacagacaggtgcacctgtcagattctcaagatggaagtgaaacttggagccttggtgtactcctgtgccccgtttgctataaagcgttttgtgttttgattttataacttcttgatgaagccctatctgtgtccccctcaatcccacttcccactgggcaatctcgttttattaaaaaattatatggtacatgttttatttttcaacttgtataaaaacccataatatattttacagagcttttggaaagtagtatcaagcaattataagtatttagcctaagagtatatggattttattaataattaatccacatctctattcaaatgcattttccctctctctcttttgaccaaaactcatgctgttagctgagaaaattcccttttcatagttcagtccatttggaatttgttgtcttgttcattggtttcttccgtgtttaacaatagcaaaatttaatatatttggagcttttttgaaactttcactcaatggttaaagaactcataaataaatgtgaaattatcagaaaatgtgcatagctcaaaggtgtttcctaagaaggggaagtaacttcctctaagttatctgttatttctggccacaaggtcactaataggctgatgtgtgcaaccaaaattattgaaaaagtgtactaccaactcgaagcaggttttttaaaacttcagattaaaaagacaatgtgttgaatatagaagaccatgataaatgagcaatttcattgtaatactcaaaccgggactcactcacattttatattttaaaataaaatggtaaatattgggaaaattgcgtatttctatgtgagggctgatcgtgagttaactggctgacttgcaaggctttctggcacttcccgtctccctccctagcccgagtgattgtggagggtccctgcagctaacagagtggggtgagcagccggtggccatgcttccggaactctctccatcaggaaggagcagatggatgtgaaccaggaacacattcatccacagaaaacccagcctctgctgtgagcggggggcgagggaggaaggttagccaggatgaggcacggtgttaaaccctacttaggctcaggcaaaataaatacataactaagtcaaatgtagaggcaacggttagagatagaaaacaggcatttggttagtgactaatttcatattctccaaaattatagcagaggttccctctgaacaaaagctctcaaaatgttacagaaattccctcctgccttttgcaaacatacaaagtctgtaggaaaacaaatcaaatagcctaaaagtttattggaaaggaaaaagaaaattccaacttatcctagcaaatatttctttaagaataaaaatggaaaaaattaaaggaggttgctaagggcccttttatatcgaacatgcttttagtgtctacagagtcagcacagcgaatatattgggaccaacagaagaagactgtaatccggcaaatgtgagctaagttatggctaaaggcaaattctgcacgtctcctggttaaaaaggaaccctttgataatcaaagtggggtgcttgggaagcgctcagaaaaccaaagggcttcaccttcctttaggctgtggtacattcctaagtatccgaaagtattctgaatcatctacctgcgttctgtcttcctggcacgcgctgactggtttcccatgaaagcatgcaacctgtacgtaagaccctacgctcttgctgggaggcaggggcggggccagcattacctgtgtttctagcatgcattaaccgtggagagttttgtaaggctttatcaacatcatctgaagtcaaatgtggaagaggagctacaaaacaaaacaaaaagcgacatcaaaatgaaaaaaaaaagagagagagagaaagagaattacctttcttacaaaaaaaaaaaaaaaaaaagaaagaaaaagaaagaaagaaaaccgttcccccactcccacactaacatcatgggaagcttataactatttccagcaacctgctacttgttagcatgttaaaacctacatgggggcccgtctttaattcagggaagaagtggttgggatgccaggcaaagcaatggaggagaatttatccacctcactgtctgtcacactacttccttctcaccatgctggacgttgtagaaattaaagcatgcagcaaacattctggattcatgccaacatgccatccctttctgtcaggttaagccgaatcacatgatacaaagtgaaaacttcccttgttctgtgctcaggttagaatataaagtggggcttcatgtagctttagggagaataatccccctaattcctacgaaagagaagccttaatgattctatttcgattcggggtatcatggagacttaactaatgtgtgaccagttaacgcttcctttcccctttgacattccatcttcttggtcgcaggaccctggaggaggcagctgagtgttgaagtgaattttggcttctcctgagagcgctgactacttctcatcaggtgatgtggccagggtgttgctcccctaagtcatcacataccaagcatgtggctccctcggatccccagtgggaactgggcgagggcaggaggatgctgtcgacacacctggttgaaccctctgaagctcaggtcataagaaccatagccacagccatctatccttggaggaagggggagcttactctctctgaggtagtggagatgtgagagaaggatgtcggcgttgtagctgggggtgagcctctggaagtcgtccttggtcatcttgcacagttccttcccatcgatgttctggaataacaagatgttgacgtctggaaggccatattctttcaccgcccactccagccactgccgcacatggtctgtactccatagcgtaggatctgaaaggggtgggaacacattcagtcaattcctgaagccagggatcttcatcttggggtagatccccatccacgtgggatttctgaccagctgccttccacaagcacagcctccagccagcctccctggctacccaggagaacattttgggggaaagacaaaagctgcctcacatccatagatcattgtctttaaagtgaatagttctggaatcttgggattattcacatcacatgcccttgtttttgctcaatctaaagtttcctgtaggcataagattttaaaaattcttttttctcatttatgttcaattttatttatttattttaaaatgagtaagaataagaggaaacttcttttccttagaaaactactggtatatttatatatatttatatggaaataagagtaagccacacatatcaggaaggtgctaattacagatcacaacaacaacaaaaataataataacagtatttatgcaaaatactgaaaaatactgaccacagaatcggaaatgaaatatagatacaccaagactctagcccctcctatgagccagcgttcctcatagagagctgtcagttccagacttttcctgcagggtgtttggttttgcaattaaccagcacctgcaggagtggggttggtgagtggtttttgcattccacagctggccatggcgagcacaaacaccccacaggatgcaggccacgtcgtcacactccagtgctacctatgggacagggagagcagggcccgggggagaaggagcaggtgatctccaacagaaacgccagccgggatgtcctgtggtaaacaccctcagtggtagggtcttcagagtgtggtaaatggggcggctgctcccttgggccccgagccctgagagacacatgggcagggagttggagccctgagttctaatctcaccatttctccactttctggaccttgctgtgggcagctatttctcctttctgtgtctgtcccacctgtaaactaagagcactgatctcagttcccgggacaagcccttaggggtcaggcatgccaggatgttccagtcctcttgaatgaaagtcaggtgtgggagtcacattttagctaatactttcagatccttgtttgtttggtcccactaatattttaggctactcaagaatggagcatgtagtatgctgctgcaatacatttttaggtttgcagaggtaaaccgtaataatagtgagaaacagccagccagtcatacacccagagttctcttcctctccctccttccctcttccttccttcgcttctccctccctttcttcccttcagctacatagaagaaagaaattattgcaggtccagtagaatctacctttcccattccattctcctactgcaaacacctatcctgaagttagtagctagtggttagaagtaaccactatcctgaagttagtacgtgtatcactcctatacatattttaatatttttaccatttaaactacatatattgttttgtgtttttaaagttaacataaacgatatatgatttgctattggcactcaatgttataatttcaagatgtagccaaatgaattcacaaagatatactcaatcattaagcagctcttaggcctcccccatgtgaataatctcaatttatttagtgaatgtcccctgtccatctccatgcatacgcgtgaatgagtccgcattggtccagggcctggggtcctttctggaatcatctggggagactgaaaaactagtgatgcctggtctcccctgggagagtctgcttcaattaggctggagggcagttgggcatcacagttgataacagctcccccaggtgactctaatgagcagccaaggttcagatcatcttccctgggcctcactattccaagcgtggtcctccaaccgcggaagcatcagcatcacctgggagctaattagaaatgctgagtctcaggccccacccagacctgctgaaccagaatctacattttcacatgaaacctggggacacgctggccttggctgagtacctagatacgggatttctgagttacagggcacatccatcttcaacttgaccagctagcattggatgtctaccaatatttaaacacccacattctcacttaaaaatcagtgcacaggccaggcgcggtggctcacgcctgtaatcccagcactttgggaggccgaggcgggtggatcacgaggtcaggagatcgagaccatcctggctaacacagtgaaaccttgtctctactaaaaatacaaaaaaaaattagtcgggcatggtggcgggtgcctgtagtctcagctacttgggaggctgaggcaggaaaatggcatgaacccgggaggtggagcttgcagtgagccaagatcaggccactgcactccagcctgagcgacagagcgagactccatctcaaaaaaaaaaaaaaaaaaaaatcatcagtgcgcagaacctgaaaactaaagggaactctggttttgctacagagagaatatcaacaaaaactccaacggcagtgatgacagaaaagtgtacatatttatttgtcatccaaacacttggaaacatgttgttagtctgtgaaaactgaatgtagatatggaaggttaatgttatccagttcactgaagttcagatgactcttcgtcattggctgagaatttggctttcagagataaaatgtttcttttttcatgacatgtcagaattcctctttctacaaaaatggatcatactgaggtcttagggcaagttctctttacctttggttctgtgcagaggatagtttgttcagccctcacagagagaagaccccccatcctacccaagtcattccctgtaagttccatcctttgatgttagcgaaacccacctttttgttttgttttgctttgcttttaacaaaatgggaggactattttttttttaatgtaacaactgtacttcctagaaataagttcattctgggaacagactttcttctctaaatggtggaaccggatattctcaaaatgacacataaacatattgtctgaaagccactaggttcgtgttaaaatggtgaaaggagaagtttaatctctctattatcccttggtgtgccccttaattggtttcgctcatcaagacaagggttatcctggcccattcagttttcctttaagggaatcaggtgcaagaccccagagacaaagtcctcaacctgtattgtacttatctctacaagtctcactttgagttggtaaaaggctgttctggagttccggagttctgccaatatgagtataaattactacagcctttctgatgaacaacacaataatacaacaatacaacacaacaatacaatcaaacgtctttaaatatgtgcagattccctggcttaaaaattccatttctagaaatttatcctaaggaaataatagaggatgtgcgcaatgatttattgtcaaggatgttctttgtagtgttgtttataatagcaaaacattggaaacaccctaaatgtccagcaaaagagaagcagttttgtaatgcatttaggaatgttcctgtgatatttagagactaaaaattacactgttgaaatatatttattgatatgataaaatgttcaaagtagattgcattttaaagtttcaaaatattattatgatatcattgtattttgcaaagatatataaatatctgcacagaaagaaattcagagggagatacagcaaaacgtgaactgttgtcactgagggaaaggagatggggaattttagatttgtcattttcactaaactatattttctcatttttctataataaatatggaatacttgggttacaaattatttatacaaaatgtattctctatttttcaaagccaaaacatggtcttacaaaaggtatatatatatttaatgtatattatatgtatactatatatcacctatatataatatatgtgaaagtatttttataaaatactttaaatactttataaaaagtattttttaaaagtataaaaaataaaagtaaaaaaacaaaaagaaaagttaaaaaaatgaaactatgcaaagcattttataaaaagtataaaaaataaaactactaaaatactttataaaaatatttttataaaataataaaatatataatatatatagaatatatacttacatatatgctatatatactacctatatatagtatatatgtgaaagtatttttataaaattgctgtcaagagtataaaaagttaagtttcagtttcttttatattttgttaatatagactgcttcatctgaaaagagtaaaattacatgaagtcagaacactcccacatccttttagcatttgatctccacacctctgccctataaatttctaagcaaacaatggtgaaaacaaaacatggccactcggtagaagaaatgagggcattccttttctcctgagcactcgcaccactctcccagacccactccggaggtgttgcaatagaggacagtttgcaggggaaaaacccagattccccagcatgaagcacacagtcctttgttccatgggtgtcattcccaaccattccccctccaccctacatttcctgagccaatgcctccatgcctgtgccacatgccacccacagcgtgaaggactagcaccttcttgtgccctcacctacactcacgacctcctttgggcatctgtcctagatgttctcacagaggaaacacttaacaaatctctgggcagtgaagtgataacaagactgaagacctagtctctgctcacactgaactccacctccactactttggccaggcaatgatgctgcagctgtagatgatggtttttagagttcaggtcagtgcactgggtccaggctgtcaggttttggtcctaaccttttaactccatgaagagccccagtagtctctctagtctcctccacactccatggtatctcagcaaagctttatggcttctgtcacaccaggaatcaaagaaaggggctcatgagttcctatgagattcagcaggcctgtcttcctcctttcttgaccccaaccacacatgtgtaggaggaaggggaggggactacagcataagccccagccgaggcatcacctttgcctatgtttaggtgcgaccttctgccctaggtaggaacacctcttgtctccaggtagcagtgtgtttggaacctgtcatttaattttataactggacctcatttttctcttctgtaaaacaatgtggagaatttcaggacctgagaaatgactcgaataggataagaactaagatagatttaattcaagtaaaagtcattaagcattatgcatatggctatatgcaccagtactatggagattccaaagtgtccaagaccaagagaaacactaaggacccactgagagaggcagcttatgaccacaaccacaaagcagaactaagtctctgtgatcaggctgggcgtggtggctcatacctgtaatcccagcactttgggaggccaaggcgggtggatcacctgaggtgaagggtttgagaccagcctgaccaacatggagaaacctcatctctactaaaaatacaaaattagccgggtgtggtggcgcatgcctgtaatgccagctactcaggaggctgaggcaggagaattgcttgaatccaggaggcagaggttgcgataagccgagattgcgccattgcactccagaagcctgggcaacaagagcgaaactccgtctcataaaaaaaaaaaaaaaaaaaaaaagactccgtgatccaaggaggaagtggaagtgcagagaggtagcaccaaccaggaaaaatgggaaaggcttaccaggagagtgaacttggattaacagcgaggattttgacagaagtagagagaagctctttggtttaggggaaccacttagcccagcctcatccgacatgggcatgaaatatctgacatgtttaagaaaaagggagaaatttggtgtggctgcagtggaggatttcagagagagcacagcaacatacgaggatggggatgaaagctgggctcagatcaacaaggtccttgagtcttgctaacaaggttggattttcatttttagagatttcagagtaattgaaaatttctaagaaatttttaaaaatcttaaataacaccaatcacagaaaacttggtgatgaaaataaaaggctttattgggaatccaaatacccacattgggattcttattcaaccatttactggacgtaaacgtcaacctctctggaatttgttttatatttttctgtgggtaattaaatgaaatgttaggggaatagaaaagtaaatgagataatggatgtgaaagcactttgccaacaataacatactgcaaaaaaagaatgcatccacacactcgattttgcattgcaaactctgctaaaatggaataagaacaaaatctgttatcacaggggcagcctcctccttaagacacaaaagtccaatttataattttattttaagaaacttttggagatgcttctgtcagatgaatcataagccattgaagataagttgttcattttcagccttccattccaattgttttgaaaacatctgtgtcatcattctacatgtcatggacaccaaaatggtaaactgtcatggcacaggctaaacagaagccatcactctctgaagcctcttatttgtatcttaagttacatggttattatgaaatctactttggtaaattggaatttaaaaaacaaataaaagtaaaccattacacacagagttctggagttgtactgttaatgtactctgtatgtggagtgggagtgggggtataagcagtgggagggagggaggaaggctgacatttaaaaaaaatatttccatgaaacaggattctgacctagtagagttcccctgttgccaggaaaatattgagtagatatttaaatcaggcaaaggggcactgcatcgccaaagacaaactgtgcctttgtgaaacaaaatgcctcacacaggcaaacatcttctttcagaggcccctctagagaaatgaataaagtaagattaaataaaagccaaactggtgataatgaaagtcctgaatgttatttttcttaaataatatcaacgtaaaatattggcttcccaaaagaaaaaaattactcttggttatgaaaaaaacatcaaaaaataaaaactaaaatgtacctctaagccatatcacaagcctagtgaggtgtttgtttataaatccaggccctgggcaagtcagccaatctgctgtccaagacactcataagcctgcaaaaataagatttaacatcttgcatcctcaggaggacagaagttacatttataaagcaggcccaatagagagaactggcttaaatttgagcaatgattcactccatcacaaatggaaatttgatctcaaataaagagcctacctcaagactgtttctgagccttttaaatttctaacttatatgtagagttcatttattgttttggtattgatttctaattttattgcacgttggccagtgaatagagtctgtatgaaattaacattttattttattttatttttttgagatagtgtctcgctctgtcacctaggctggagagcagtggcatgatctgggctcactgcaacctctgcctcccaggttcaactgcctcagcctcccgaataggtgggattacaggcacccaccaccatcgtggctaatttttgtatttttaatagagatggggtttcaccatgttgtccaggctgatctggaactcctgaccttaggtgatccacccacctcggcctcccaaagtgctgggattgcaggcgtgagccaccatgcccagctgaaattagctttttaaaaagttccggtttgttactcttttggcggcctagtgcatggtcagtttttataaatgttccttgattgcttaagaaatgcatattctctaatttgggagtacagagttctagaaaaaaaactcttggtaaggtgtatttaattttaatgtcactgacctatcaattactgagaaatgcaaattaaaatatctcactaaattggacttgactatttctttttgcagttcattacatatttcaaggctatgttattaggtacatgtaagtttatcattattatatatttgtcatgaatttagccttttttcactatgtaatgaccctcaattatctccagttatgctttctgcctgaaagtatatttagtctgctttctatttctatttttgtcagctttttaaaaattcaattttcactagcgtatcttattctgtcaactctcaatctttgtttgtgcaagatttttttgtaaacaacccataactgattgtggagtattttttagtctagtctatcactctctgtctttaatggcaaatttggtctatctacacttattatcactgatctatctgatttttaccatcttattttgtgctttatgttaaactttcttagtccattctctatttctccttgccaagtgtctaatcagattgatctacttttcttcattcacttttttttctttgtttctgtattggttttgctctttgacattctagttctctttcctgttaatctttaaacaaaatctaagtttaattaccagtaatttagaaagcttatacttgaatcatccatctctgattttacatgacaatgttccctcatatttttactccactgaattttctactccctacttagggaggctgtggttgtcattttacagccatttctttctagatctaccctcaccttaatcaatttcattgctcccatttccttcctgtatctcactcccttcttctaggatccattttttaaattaaatcttttgttattatctgaagtgaggttcaattagcaacaaactctctttttaactccttcttttatgttcttccttaatatttaaaaagtttatttattttatactctttatccaatactttaattatttaaccttctgcttaatcatgttcattgtttctgttaaatcttggttgggggagatctctcttcagctatttttttgtaatttgcgggtggcagagtcatctttagcgggtctctatctgcaggaattctgtacagcgtaggttgaagacatgtctctccatgaagatttcgtatttacttctgccaggtttcccagattatcactagcccatgaccatttttctgtattaatttctcagccttagagttcctggcacacactgttgtgtgtatggggtggggactcgggtaatgacaggctcagttccaattctctgctttgtggaagctcaagatttcattccttgcccctagttgacctttaaaacccaaatctctgcattatagcaacctaggacaaccaggtgtcaacataagaatgtgctgctctgctctattctcacttttttccttattttagtccctaaggagttcattgcctttcttcccagttcagctgtgcatttaaaaggatgttaaactccatgcagcaattccaggtgttttgcaaaaggaatgtttctcaggtccttttatagtaacctctctattttactagaaccaagagccctctctgcatactttttacctatttactttgaatagttttcatttttaatgcagccatcatcctaactcatgttatgctttacttcattcatttattaattaatcaattgtcaaaaattacttatatgaattgtataatcctctatgaaagattcaaaaatggcaagaaagagtgcctgtcctctacttgtttgagaatctacaattctgtgtattttatttaaaaatacatgactaaattatttttgttaggctctaaacatagctttgtcattctgacacactgatttatttctctggatgaaaccattctcaagtaatcatcttgtttttggataatgatcgttattgttctttgttttcttttgttgttgttgcctcctgttattccatgacaacattgtgtgtgctcatcatgttttagaaatgcaatggcttgttccacataaaggtttctccctgcctgggttttctttctttgtcttctctttaaatgttgctatccccagagtttcatccttggtctacccctctcctctctccatatgtatctttgggcattcttatttgctctcatgtttgaactataacatgcatgctgtattattttcctagggctgccgtaaccaagtaccacaaaatgtgtggcttagaaacaacagaaattcatcgtctcatagttctggaggatcaaagtctgaaatcaaggtatcagcaaggccttgctccatccgagactgtggataaaatctgtccttggctcttctagcttctggtgctgtccagcaattgaatgttccattgcttgcagttgcatcagtccaacctctgcctgtcttcacatggagttctccctctgtgtttccatatcatcttccctctgtgtgtgtctatgtccaaatttctcctttgtgtaaggacaccagtcattttattaggctcaccctaatgacctcatcttaacttgattaaatctgcaaaacctctatttccacataaggtcacattctaaggaactgggggttaggacttcagcatatcttgtgagggaggcacaattttttaacctgtaacaggcagctgtttctgccagtctatatcttgagtccccagggcactctcacagatgccagacccaaatataaacagaagaactgcactttttatcccaggtactgtttaagcatgtcacacatattgctatatttaatccatatagcaccacatgaagtaggaattattatcatccatattttggtgatgaaaaacctgagaaacagcaagattaagtagcttcccagatcccacagttagtacatggcagagtttagaactcaagtgctgtgactcccgatcaaggactttccatcctgagctctaggcccaccacactgcctgacaggtgtcccagaagcatcttaaacacaggatgaaccaaactgaaatcacctattttaaacattttttttttgtatattcattaacacctacccagctgctcatgctaaatctaagctgtcttcaattccattcttctctttgactttcaagaaaaacagataacatcattagcactgtagaaatgtaaaaattagccctgggcaacacagtagattattttacaaaattccctctccacctcctttgtttacttaagtcttatttgaaaaggctgttgcagaatgtctacaacaatttaacaaacacattctctcatcccattcctgtgttctcccctgggtatttttgtcagcacagcttaggaagaagaacccagactgtggagtcagaaagaactgggttcgaatcctggctcttcaaatgattggctgtgacatatttggcaactctcttagcgttcctagttttagtttctttactgtcgagtgagaatgataatgagtacctacatcatagggtggtcgcatgatttaaatgagataatgccttttctacaaagtgcatgtccaagtgcctgacaacagtgcatatcaatagatagtagctgtcgttgctttttagaaaaatgacttgattttagcctcacatttaacccaatggtggtttcctcaaccgctattcagctgataactttaaaatacacataataaactttgatgttagcatttctattttagtgggttttgttatttagttgtttgagcatagcaggaatttaaacagaagattaaagaagcatgtcccatcatatcgacagagtggaagagatcctcgggtgtgttcagggacgtaacaaagaaagatgaagacacaagtcatttcaccagcaggttctgggcctgagaataggctctggtctcacccagttgtgcaagtgttcccgggaaagtcatttcacctctctcagtcttggttttctcatgtttaaaggaagactgaacttagaccaccaagaatcctgcaacccctgcgagtctgcgattcctgctagttagatctagattactgttaacttgataaatcacatttactctcctccacacagaatccaagtgctggctgtgttgtctggcgattgagaacacaaaagacatgatcatcacctcactaaacttacaatctaatagaacagacaggcttataaataactcacgctaagaggattggaaacataatatatcagccatcagggcttggtcggagggtatgttctattacttgttattcactggctttcaaagcccagtgggggaatgtcaatatttagggaggatcatgtggaaactatgcagtcctctaacactctgagaactcaagatcccttctttacatgaaatcagactgccaaagactcatgctgggtgtctgtcctctacctgtgctgagctattctctaatgtaactcagcgctcacagaagatgtcacaagaaataagctgttgaaatgcagtgctgcaactgtggcaggaagacggtcgatggtcaggtctatggccccagtggccccaaaagggatccttcttttaggattctacactatgataaacattgccttccctgtgaaacttcttttttgaaaggaaaaattatttccccaaataactcttttcattttggctgccaggaagctcaaagccatactagaaacttaagtacagcatcttgggcaagcttgtggtcaaaatggctgcattcttccctcacatgctcttggcttctcatttgtatttttaactgccttagcactgattcctaatttccatttgataagtcaattgggtataagcccatcagtagtttagttcacacggcacctcaaatcctttgcagaatatccacatttaagtaagtatatacatgcatttgagaatacaatatgaaacaaaataaagtatgataacaaaataattggtaagatgtcataagaggagtgattaatttgccagaggatcaagcatggctcccttgacagggcagattttgaagatgtctggaagaatgagcaagagcattccagagagggaaccgcagggacaaggacaccgggtggtgaaaatgcagcgcgtgagttggggatgtggcagaggaaaacggcagaggctgcaaagggctttcgaaatcacatcatcgtgggtataaatgaagctgttcttgattcgtcctgtcatagcaatctccattcctcacatgctctgaaatactggtctgagtcattcatttgagctctcaatcacaccttctcctgtctgtcaaaaactacttaccccacatgggtgggtcttagctacttctgacagccttcggtcatctcctcagtgattaagagtaatgggaactccatgaacactttctaacggaatagaaaggtcctagcacaggggtctgagtaagacacaagtcatgtagcttcagccacacatgtttggtgggcaagaaaaggtgattttaaatctcattagagcttttattcacggtgaatggaacacagtaagagtttaatgaatgaattaataatgaagaaagtgaagagatacagtgaagagaagaatgtggctactcttatctctgagattactgattattgcaagggtctatgctgaaagtgaattattttaaaaatagaagcagaggcatttgaaaaactcaacactttagcacctattttaaggaattaaaacagaaaaagaggccaggcccggtggctcacgcctgtaatcccagcactttgggtgaccgaggtgggtggatcatctgaggtcaggagtttgagaccagccttgccaacatggtgaaaccccgtctctactacaaatacaaaaattagctggctgtggtggcaggcgcctgagatcccagctactcaggaggctgaggcaggagaattgcttgaacccaggagacagaggttgcagtaagccgtgaccgcgccattgcactccagcctgggcaacagagcgaggctccatctcaaaataaataaataaataaaaaataataataaaaaaacagaaaaagagaaatctttcaaaatgctataagctgctaaagcgagaggtcctattgcattttggtcagcattttgcaacttttaagaagtgaatggagcctgtgccttcctctttgttagccacttggttagcacatctccatgttcacagccaacacctaaagagtaacagtaactactgcaatgagtgattcttcatttttttttggaatgttaatgtgatactgttaatcatttctatctttcctttttgtctacttgccttttctaaaagtgataaaccatatctttattaaaaataattcaagtctattaaagtaaaatttatatcttctatctagattagaacttttcaaccttattgtacatgaaaattacatacacaataagcatgttaataatgtaaaatttccaaccccacacccaggtttggaacatttggaagtgtgtgtgtgtgtgtgtgtgtgtgtgtgtgtctgggaaagggtctcactctggcttcctggtgggagtgaagtggtgcaatcatggttcactgcagcctcaaacttctgggctcaaagaatcctcccgcctcagtctcccaagtagctgggactacaggaaccaccactacacctggctaatgttaaaattttttgtagaaatggggtcccactatgttgtccaggctggtcttgaactccttggcctcccaaagtgctgggattacaggtgtaagccactgtgactggcaggaaatgtgtatttttaatcataaattttccaggtaatcttgatacaagtggttctgaccatactttgaaaaacactttctaggccaggcgtggtggttcatgcctgtaatcccagcactttgggaggccgaggtgggcggatcacctgaggtcaggagtttgagaccagcctggcaaacatggcgaaaccccatctctactaaaaatacaaaaattagcctggcgtggtggcgggcgcctgtaatcccagctactcaggaggctgaggcaggagaatcacttgaacctgggaggcagaggttgcagtgagctgagatcctgccattgcaattcagtctggggaacaagagcgagactttgtctcaaaaaaaaaaaaaaaaaaaaaaagaaagaaagaaaaagaaaaacactttctagtcaacctccaaattaagctcggccaaaaaagagccatgtaaccagcatgggggatgtcacacttgtcaggcccctcttattacaactggtttcactgaatgacacttgggtttacgacagtgtaagagactgccctgccctatgagagatcctcctagatttacagatactcgcaccaaatacatagataaaaaccagagatgggaattatggcctaaccagtaccctttgggaaggcacaatcaacagtcttgccagaacaacaggcacaaaccagggctgcccagaatgcctggtggcgctactggttgaatgctttgctcatgactccccttatcttccttaggacaaacagaggaacacatcttcctccagactcagaattaatagctggaccatcttttcacatttgctttctttttatcctgtaggcactgaattatccctttcatactgcctgatgatacctcgaagccaaataacacctaccttttgcaattctgcaatatttaaatgttgcaattaaaaatacacatacacacacacacacgtgcgtgtaaacctcactcctggttttactctctctgttcaatttttactttagtccattctccacattcctttatttttaaaaagtggattctaccgtgctctttcatatgtatctatgtgagctttcttaaatctgttctgaaataggaggcagtgtaaatatatcaagtgacagtctacatttatccttcagggacattttctagttgacactttcttatgggcttttttttgacactttttttatgggcttctttattaactcaagatcatgagtatcaaaaccagggttgagggaatcgcttctcaaaagtgggttccaggtaccagaacccaatctgaacacggacaaagccccccagctcctctgtggttttatctctcagtctccgtacagtacaaatttcctcatcagtgtttattagggccactgctatctctagtgtgtaaacatcggcatgtattgatgatggtacaaatgtttaggaataactgatggtttttttttttttcactcagctatccgtgtgatttgcattagtgccaagcaatgtctctaagtagtaaggtctatgtgaaccactcaggaccaggtctggagaattctttttgcacacatggggtactccgtgccccaaatctgccttagtgaggtgcctggataccatggggatggatacagcagctggtacagctgcctgaggtcctgcaacctcatggccacattggaaaattgtccagattgtgcaatgaagctgtgtgtgtgtgtgcgtgtgtgtgtgtgtgtgttcatctctgtgtgtgtatgagcacacatacatgaagcttgaccaataactgaaagactcacaacttgcaaaatcagccacaactagctctcttacaaacactattaactgaataactgcctacactggcgtgaagcaactgaaggagggaagagctgaagagaagagtactttgctccaaagaaaggaaacagccttcacatcaaagcttactataagccaatttgcagagctatccttgcatccatccagctaatatttgatgagcagctactatgtataaaaaatcctgggtgctctgacttcagttgattctctgttctcttccccacacaaatatctctcttattttctaaatactttccttagtgtagaaagactcaagtctggccctactgaaaaggatatttatgacatcaaagcatattgatggcctcatggaaatacagcctcaccagttagaagatggtaccaggcattacctcttacatctgtgattcaatgaggaaccaagcaaggaatcttcagtgcaggccccctcagatggattctctcatctttgagatctaaacactttgttttgtctcctttgaagaaattacattcttaaggaggagggcaaagggtgagatgggttagggggcttcctttgggtgtctacttcactttgttcatgcccagagagtgtctgggcaacacaccactgccctcctgcctctcctccaggcacatcctagccttcgagtttttcttatgtgccacacatctggagtgggcacctgggacatttgtgtttctatttttcccatccaacaggaacagccccctgttctgaggcacagcagcaagtgaggcagtctcaggcattcaggtgcattgtcaagatcaaaccaaatgcatggcctctgtacctgtcaactgcctttcagtaaatactaaggacggttttctccctttcgtaatctaccatcagtgtctcctgtaagtcttaaaaaatgctttgaaatcaggcacaaccccaaaggatggtccctttcacaccccactgcatcgaaccagctttacgtgtttgctgaaagtcacatggtgacagatctaagctgaaacctgggattcaaatccaggccagatgttttgcaaagtaccctgcactcctgaactcttctgtctagaaggtgacagaagcccactgggcatgatccaactcaggtaaagggaaagtcacaccatggagggaatctaacctgtttgccatcacacttcgcagatattaatttaggtgaccccaggagcaagggagaattgagtttgtgcagatttcacccatgcatgcccttggctactttgccaacaaggagtaacttgtacagtgcagctcagtggtgaggtgtccgttcatccattctccacctcccttaatattcactgagcacctcccacttaccaggcactgcaactggccctggagatagggcctttgtggggcttatgttccattcagggaagaggataataagaaaactttttatttttttatttttattattttgagacggagtcttgctcttgtcgcccaggctggagtgcaatggcacaattttggctcactgcaacctctgcctctctggttcaagcgattctcctgcctcagcctcccaaagtgctgggattacaggtgtgagccaccatggctggccagtaagaaaacttttacataaacatgcaatataatggcagaagggaatgaatgaaatcaagaaaaatcaggccaacaggagactggcagtcacaggtggagacgagagcaattccagacggaagtgctcaggactggcctccctgaggccatgacattggcacggatacttggtgaaggaaaatgatatggaactacctggaattaagggtttcaggctgagctgacgccaaattcaaatccctgaggcaggaccgcagggtgaccagatggctgaaacaagtaacaggagggaacccacagaaattgctgtaagcagctgagatttaatccaatgccaacaggcagagactaaaggagtaaggcagacctgcctgagtcctaacttggcctcttattagcctaatgcccttggaaaagttggtggacctctctgaacttcatcttcctcatcagggaaatcatgagaaagatgtccatttgcaaagattgcttgagatcacgtttctaaagcatttatccaaatgcctcctgtagggtaaaggttcactgactggtgactgttgctgttgttcttatatttctggctttaggtagcatgtatcctctgaggagctttaagtcattttttctattacctttagtttggctaaataaataagttcttgtcacgtctttcaagttcaagagctattcctttgggttggttttgaattatgtttgtggtaaagagttactctggttattagaatctgtattacaggccagtgatagctggaattttagatgcttaagggaacacgtaagacagccatataatatatggctcccacatgtttatttttccagataagagaattttaaaaacaaacaagtctatcatctatcataaatagtacctcatgaaggacaggatatttggaacaataatctccaagaagtggcaattcctccctagaaaggtcacctttcatagacatatacacacgtgtgcatatgtgtgtgcacacaagcaaggctgcatgtttgcctggacatcctctttctctctgtctctctccatacgtagtgtgtgtgtgtgtgtgtgtgtgtgtgtgtgtgtgtgtgtatttttctctatgtggcaaaataaagagctggggctacatactgctgtctcacatattttttaaatatttgtatttttaaatacaggtgtatttttcttgctttgctgtcgatccgtgaacatgtcctcatgcatagacctctgccagctcccatttacaagccctgctctggacaaaggagatgtgatcaatgccacaggtgggggagaagagctccctgaggctcagcctagccttggggaagttgcgatctgccgagggcagtgaagctgtgggcacctgacctgctggcacgataactctgcgctcgttcgtggtcatgtttgggggtggcatgtgcttctcctccatgtagctgccgtagttcatcccaacggtgtctgggctgcccaccatcttcccgcctttggccacactgcattcatcaggagagttcctggaggagaagaaatattcttccattataacagcaatcaaagagcatgtctccatcgacttctcacaatacacagagagaaccaaagaagggcaaggcggaagagactgggggagaaaggacaagtgtgaaaagccaaatacaggcggggtgccgtggctcatgcctgtagtcccaacactttgggatgccgaggtgggcggatcatgaggtcaagagatccagaccatcctggccaacatggtgaaaccccgtctctactaaaaatacaaaaattagctgggcatgcctgtagtcccagctactcaggaggctgaggcaggaaaattgcttgaatccgggaggtggaggttgcagtgagctgagatcatgccactgcactccagactggcgacagagtaagattccatctcaaaacaaaaaagaaaagaaaagaaaagaaatgccgaaaacaggccttgccttctgtcctcccgaaatgcatattttgaagccctaactcccaatgtgatgatattaggagagagagcctttgggaggtaatttcagtttgatgaggtcatgagggtagagtcccacgatgggattagtgcccttattagaaaagaaagagaccagagctcgagctctctctctctctctctctctctctctctctctctctgccatgtaagggcagagcaagaaggtggccaggccatctgcaacccaaggacagagacctcaccagagactggccctgctggtgtctgattttagacttccaacctccagaagtatgcaagctcgagtcccattgtttcagccagccagtctgtggggctctgtgaaggcagcctgcacaggctaggacagtgcccatactggctagatgcacagaacacgcacaagggaggcggaactaccacctggcttctgtttcttaagcagctcctcctgaaactgtcatgtcaaaactccatctgtgacaactgattggggacacttgcagggaacagtgaactgctctttgttctcgcggtgtgacagcaaacaggcagagtagacagatgctgtggggcggcaccagggacactcgctgctcagtgaggtttatcctggaacgacgttccttctcaaaacctcagaatgaaatcctcctgctcaatttcaaatccctgcagccaatctttacatatggagctttgaagactcacagtgttccaggcttaggtgtagacaggaagggcagggaagggtgaggactgacgctaggggaggcctcatggggagtggactccagcagtcctagaggacccttgggaaagggatagggaaggaactgtgtggatgcagagaggggtcagctactgactactgaccgtgggcaacaggtcacagggctgctgttagtaaggcagtcactgtcatttggataaagtcaaacctacctttctggaaaaagaaaaggaaaacattttaaacagtgagttgtgaaagctacaggacattggtgaaatcgcatctgatagggaaatgctaaaaagaaaatccagcttagggccaggagtggtggctcacacctgtaatcccagcattttgggaggccgaggtgggcagatcacctgaggtcaggagttcaagaccagcctgatcaacatggagaaacccagtctttactaaaaatacaaaattagctgggcaagtggtggtgcatgcctttaatctcagctactcgggaggctgaggcaggagaatcccttgaacctgggaggttgaggtcgtggtgagctgagatggcgccattgcactccagcctgggcaacatgagtgaaactccatcaaaaaaagaagaaaggaaagaaagaaagaaagagagagagaaagagagagaaagaaaagagagagaaaatccagcttaagcagaaaacagaaaatacatgtcagtgccttcttagatggttaacacgtagatggtaaacccagggtcactgtagctgagaagtattaatatttagggtctgttgtctaaggcggatttccagaaatgcctctcaggctctatccaatgcatacatttttttcatattccttggaatctgggaaccttcgctttctctagattttagatttctatcccagtgtttctggttgtgggatccacgccaatgaagcctcatttatctcctccacttcttgttagttggagttctgcagagaacttggacaatcaaaaaactatgggcttggcatggatgtgaacttcaagtctaaggaggtcaaaaccatctgaggcaggagcgcactttctgagtggggtgagatggagaaggtcattccacacctgaaagccatagctgggatgtggacaggaagggaaagtgtttgttcagcatgtgggaacttgaaaatataggtttgttctcagcatcacttacaaatgtgtctgaagcctatggagggatcttaggtgttggcagtgaagagggtacactgccatctgcggatggaggttacagtcagggtcacgcaggactcaggccctaacatgggcctggaatgcacagccctgcctgatggcatcctcacagctgtgctaacatgaaggaaattttaaaataataatggtctgagttcccatgaagtagatcctgaatatttccaccgctgcctacacatgcattatttcctcttgatgctatttttcctggcttcacacatttatctctaaaagacccatcctaatatgaaaacacagagtgtcttcacttagactgagtttcctattcctctggaaaattccatcagttgagtagagtgtatatgttttggtatatttgtctcaaggagagaagttaccagggaagagaagttagagggattaggttctttaggaaaaagactttgcccagatgatgtgagtaactcaagtaacaactataaaatctagacaacctttgttcagattcaatcattcactcatccatttagacagctgttatcaagtgccggccgtataccaggtcccatcaattctttcttctccaacaacgcagttaacaatttgaaaagtaaaagatcaaagagatgtataaaattatagaaacaggccaggtgtggtgactcacgcctgtaatcccagcactttgggaggccgagctgggcggatcacctgaggtcgggagtttgagaccagcctgaccaacatggaaaaaccctgtctctacttaaaaaaaaaaattagccgggcgtggtggtgcatgcccgtaatcccagctactcgggaggctgaggcaggagaatcgcttgaaccagggaggcggaggttgcggtgagccaagaccacgccattgcaccccagcctgggcaacaagagcaagactccatgtcaaaaaaaaaaagaattatagaaacaggggacattgaggattttgaacccttcagaccaacccctttttcattttcttttagttctttctagtttaattttcatatccgaggacaagaactctaggcatagatcacaagagtttctctgtgacattaaagtagatccttcaggctggttgcggcagctcatgcctgtaatctcagcactttgggaggctgaggcaggcagatcacttgaggctaagtgttcgagaccagcctggcctcccaagtagctggcattacaggcgcctgccaccacgcctggctgatttttgtatttttagtagagacggggtttcaccatgttggccaggctggtctcgaactcctgacctaaggtgatccttctgccttggcttcccaaggtgctgggattacaggcgtgagccacttcacccaggtttctcttgcaaattttaacagcaaaagagtagccttaacatgtttgggatctgttttgggagcttaatagttatcagtcttcaccacagcgaactgtgttgctggcattgtctccactttccagaggtgtgaactgagtactcaaaacacaaggggctggctccaggactcacagccaggaggaggtagaatgagacttcagtgcgggtggcccgaactctccatccctgcttcttaaccctgaacagaatgactccacaaagtaaaggcaagacaatgtcttttcaaaggtaactagatcttcatttcaggaaggcatcagggactccctgacccatacactactctggtttaaggtgtacactaaagcactcatcctgacatactctcctaccctgggactgttcattccctgaaaagcatgtgcatgacacaaacagggcacatatacaagatgcaaataagaaagaggagtgattcctggagaagaaaagaattttcagagatatctgctttacttaagaaaaggacgccaggcacagtggctcacgcatataatcccagcattttgggaggccaagataggtgaattgttttagctcaggagttcaagaccagcctggacaacatgaaaaatgtgtttacaaaaaatacaaaaattagtcgggcatggtgtgcacctgtagtcccagctactcaggaggctcaggtgggaggatcacctgagcctggggaggttgagactgcagtgagctgagatcatgctactgcactgcagcctggacaacagagcaaaaccgtgtctcaaaaaaaaaacaaaagagagaaaaaaagaaaaggaaattttatcacaattcagagaactgaaaagtgttcatttgaaagtctcactataaatacatttctagctctgtgcccaagaaaagatccacactgcacaaatgtgtgtcttgattactccactgcaaccccaccttcaccaggcattccgaggctcacacatcgccgggaaaaagttcccgcaaacagcttggtatgtcacctgcaccaagcgctgcccagcatagaggaccacgtgttctccattctcacatgataaggatttggacgttcaatgcattgttttattgtgcacatgacaaagagtatgctgtgcagggaatgaacagtcctgaagtaggacagtgtgtcaggatgagtgctgcaatgtacactttaaaccagagtagtgtatgggtcagggagtccctgatgccttcctgaaatgaagactagttaccttttaaacatacacatacttttaaacatacacatacttgcatatgtgtgttgcagcagttcctgagaatattctcaggctattcagcaggtgcctgtcaaacagataatcatttagtaaatattaaatgtatctgtctttttgtttggggtggaaatttctttattgcaaataagcgtggttcaagatattgctctcacagactcctttgaggacaaacaaaaatcattttgtctttttatttaatttaaatagttttgggggaacaggtggtgtctggttacacgaataagttctttagtggtgatttctgagattttgttgcacccatcacccaagcagtaaacactgtacccagtgtgcaatcttttctccctcacccactcccatgcttcccccagagtccccaaagtccactgtatcattcttatgcttttgtgtcctcatagcttagcttctagttataagtgagaacacacaatatttggttttccattcctgagttacttcggttagaataatggtctccaactccatccaagttgctgcaaatgccattttcttccttttcatgggtgcatagtattccatggtgtgtgtgtgtatatacacacacgcatatatacacatatacccacacatatacatatgtatatatgtacatatacacatatatgtatatctacatatgcacacatatacatatataatatgtacacatatacatatatatgtacacatatacacatgtacatacgcacatataaacatgtgtgtatacatgtatacacgtgtacacatgtacatatacacatatgtgtatatacatgtatgcacatgtacatatatacatatgtgtatatacatgtatgcacatgtacatatatacatatgtgtatatgtacatgtatacacatgtacatatatacatatgtgtatatgtacatgtatacacatgtacatatatacatatgtgtatatatacatgtatacacatgtacatatatacatatatgtgtatatatgtatatatgtgtgtatacatgtatatgtgtgtgcatatatgtctatatatatgtgtgtatatatatatacacacacacacacacaccacattttctttatccactcattggttgatgggcatttaggctggttccacatttttgcaattgcgaattgtgctgctataaacatgcatgcgcaagtgtctttttcatttcctctgggtagataaccagtggtgggattgctggatcaaatggtagttttacttctaattttccatactgttttccacagtggttgtactagttccatagtggttgtactagtttccatgctgttttccatagtggttgtactagtttacattcccattggcagtgtaaaagtgttcccttttcaccatatccatgccaacatctattttttttttatttttaatgatggccattcttgcaggagtaaaatggtatcaccctgtggtcttgatttgcatttccctgataacaagtgatgttgagtgttttttcatgtttgttggccatttgtatttcttcttttgagaattgtctattcatgtccttaacccattttttgatgaaattatttatttttttcttgctgatttgtttgagttgtcgattctggatattagtcctttgtcaaatgcatagtttgcaaatattttcttccactctgtgggttgtctgtttgctgattatttcttttgctgtgaagaaagtttttggtttaactaagtcccatctatttatctttgtttttgttgcatttgcttttggattcttggtcatgaactgttattctcaaatttacattttcagttccaggttctatttgtcacccacagacattagtcttgacagtcctatgcaatatgtggcatcaacaagagtaaacaggagctgggaagacagatacttccctctgctcacagcagcagaaattccacattagccagggggccccaagaggtggggggctggttcagaattctgagaaagaactgaacaatagcccaatggctgggatattaaaaagccagccataacacctcacaactccctagcaacacccttggggccacacagcctcaaactcctgagctcaagcaatcctccttggttcagcctccctatgaatagctgggactacaggccacactccttgaggagtgtaacctctgcagcaatctcacacttttccatggcatttggtcataactgtggtcactcacaggaacacagaaatagtgtaggaagacaaccaaacattcatgatggaaataaaaaaaaccagaatgctggtgtccttcttctagtaactggagacgtgcccaatgaaactggcttgttgagcttcaaacaataatctcccttaaacagcagttggagaattaagttctaatcatttaaaatcatgagcactgacttcttaaaacatactagtattctgaattaatgagaaaaggacacggcaaagaatatcaaatacattggaaattttgttaaatttgagttaaggagagaaggcagacacgttgctaagcccagttgggttctcatagggttactgaatcagagggctggaagaagccccattttcaagcccccagacatgactgtctggaaaccacttggatgaacaagagtttagcttcgttaacagttttttagggaggggcttcgtaattttcctctgcaactccagagttctatttataaatatgtatagtggttttaaatagccattattcccctacctgtgtgcaagctatgtgaagtttggggtggcttataaaaatacatataagacaaaatgataacataaataattaacagaataaaaatgaggaaacaagggccaaaaaggaattaagagatgaaagcagcccactgagtaagcttactatttatcctgctgaggtaggataccaattcaactctgagctttctactagccaaagcaaagacacaagtgcatctgatgacaaggtttgaggtattaataagctacatacaaaccagttattcagcagaaataaagctctccctgggttaagctttgagagtttttctcggggcttctcatgaagaaaactggattatgcagtaaacaatatcgttcccaacatctcataatacatctaagaccatcccgcaccgtgccaggcgtagctggtggcagagcaggacgctccctgcacacagtgctcacatgctgcagccacagaggatgagagacggcatgtccccagcctctcctccttactggctgccattggaaagatcagacctgtcagagaagtcaatgcaaaaacatgaaaaaaacgtgtaattaaaaaaggagaaaaccttgagagatgcagtgttatacatgcctctagtttcataactcccaaatttctagatttgatttgattttattgttttttaagagacagggtcttgctctgtcacccaggctggagtacagaggtatgattatagctcactgcagtctcaaactcctgggctcaagcgatcctcttgcctcagcctcccaagtagttgggactacaggcacgtgccaccacacccagctgttttttaattatttgtatagatggggtctcactatgttgcccaggctggcctctaactcctgtcctcaagcaatcctcccacctcagcctccccaagaactgggattgcaggcatgagctgctgcactgaaacccctaatttctagattttaaattcaaatttaccaacactaaatagggtcatgtttatgtctcccaagagcaccaaatgcactgtgggtaaacaactctttccaggcctcagttggttaatcttccaaccagtatttcactgttgactaatgatgagcatggctccagactctttccacgtgtttatgttataataaacatatggataaagcatttaacatggtgcctggcacatgaccacgccaggtgtcagctattgctgttagttcatttcatctgcacatctccatgacagaaatactcgaaagcaggagccttgttacagatgaagcacagagaggttggataacttgcccaagatcacacagccagtagtggaagaattgggatttgaacctagatagtcatggtctcgactccaagtacttcaccgccccactctatgcccttgcttggtaaatccgtgtgaggagtctttcatagacctaaagcaccattgaatggatcctcagaaaacttaatttcatcactattaagtattctaaaagaacatcttcagagtggccctgaagacagtcatggatgagggttacagacgtgagctgagcagggcagccacgaaggagcaaggcagggccccgtgggagacttggaaggtggcaatgtttatgtagagatataaataggttttgataagtttggtctaaaagaaatagtcatctcaatttgcagttaagcgttctatgcttctccccaaaacttcattgctgtgcccagcagggtgcatgttttacacagatgatgggcaaacattcttaagtgcaaaaggaaaccagacaaaaagtccccatgacgagacagccgagtgggagtgcatctgactctgactgcaggcccaaaaagatggaggtgaggaccaggacaggagctggaccactggggaagcagtcaatctaattttttaagattaaataaaataagtccaagatgaaagcctccttgagctgtcgtccatacataataccccttaaacaaaaaaaaagcggggttggtggtggggactaatattactgaaaaaacatactgagaaatgtaaaatttggtctttagtctttgaaaaacaaaataaacttggcatctgactttggttttctcacatcagagtctacttacagcgaggcaatttccgtcatggaaagaacccgcaatgaaatggcacagccgtggccattagcttgacaagcatggagcctcagcccttgtgagtgtgaatgggcctcatttatccaagaacggcactgaatacatcccagaggggcagccccaagctcgctggccacattaaatctgattcaccctcacttcagaacacttagcaggggcccactccttggagaaagtccaaggcaagtcagaatgtaattgcggaaatcaatatgtcttcttctttgagtcagtggaggcaaacccgctaatcctgtcgaaaatctacctattcttctagagccatcctccttcctaatcctctgaattcctcttgcacctggacacgactttccaaccccttgttctccatcacatgctggtgaaatgtccccgaactcttccaaagctttctccctcctgctaccagagtgctctcccccaaacagaaatgcaagctgcccatgtccaacctaacccccatcatggcccagagcccctccctagattctcctcagtgatctggctctggagcccctcaattcactcatttgtttagcaaatatctgtggagcatctttctaggccaagcactgccccaggtactggagttatatcagtgtctctattaacatggggctggcatttgagtagccaaagcccctctccccaactccatgtgctctgtgctcaaagaccacattccacatcaccccctagtctcttcccttcaggccttcacttttgctactccctctgccttcaaggcctatgaccacctgatacctgccctattcacctgttcaccacctggtacctgctctattcacctgtccatgctcacctctaggttctctacaagcctttcctgggccgccagagaggaatgtctcccttccaattgcaccattctctgtattttctcagtaagtgtctgcaggatgagtgagtacatttatgaatgaatcttccatttaaatattgagttccttatctcatacctgcagtgcaagagaaagcccctcgtgttgcagtcagaaaaccattgctgaccttggttgaccttagatgggtcacctaacctttcgaggctcaactccttcattcataaaaatgaatggatgctttcttgaggttgctgtgaggacatccctgagatgatgcctgtgaagaaagtctgcaaactgtgaagcactatacagattaacacagcaacatactgcatgtgcatggctgtgcatgcgtgtatgtgggtgtaaatgtgaggctttttgttcttggcaactgttcataactgtacctcggtgaactcttaggtaggtcaggaagctaaggtttactattgtgcagtgttcagcatgcaactgctttttggaatgtcactgtctttctgaatgttccttttggtttattaggttagttcacattaagaagaacttggtgaggaagccacatggaagaaatggaaaggctttctttggcagctctaccctaagagggcaaaggggtcagttctgcgagagaacccccacaaggaggctggcccgggacaagcattccaggcctgtctcaagtctgaatacaaataaatcccttctcaggtggttttcttcataaggatcctaaaagcatatacttagtcctaatcgactgagcaagctcctaatcaagtttcatagtgtgaatcggaggtcagtcaccacaaaaggtatttttaggaccccagacaaggaggggattgtctggagcgctgcagggtaatttgtgggtctgttttatttctgaatcagaggcagtggaaaagctgtttcagaccccatggctggagcagcgggtggagctcagcagtgattcatgtagaactccgggctcaaactgaaaccgtagatgtttgtcttcacagctgtgtgttatttttacccttactaaatattctctcttacacctggaatttcagcctcttcccaacagtcctgttccctcccccttccctgaagcagttgaagacaaaattaattaaaaagtcaccaccagctcaccaacagttagttctttgtccccttaaaggggctcgatgtttccctgagaaagtttcattatttaagtttatatttctctttacagccaaaaacgaatgccagcaagaccgtgttgcttttagatcttgaaaactggagggaaatgcaccattttgggattcatcatttgaaaacaaaatgttctgtagcataagatctctacaagcagttacatgacaaagatcagatgtgacatcttttctatcttgtgcacgtcttttaatttgtctgaaagactcctttttcagagaagaaaggattgagcccaatagccagtatggtgcttcatgtttttataacaggccaggtgaatcctggtaaccaaaacaattttactttctttttttcttttttttttttttttgagacggagttttgctcttgttgcctaggctggagtgcaatggcgcgatctcagctcactgcaacctccgcccccactgggttcaagcgattctcccgcctcagcctccgggattataggcacctggctaattttttttttaatatatatttttagtagagatggggtttcaccatgttggccaggctggtctcgaactcctgacccacctattatttttaaaatgtgattgttttggaaacacctggtgaggttaatgtaaaggtgagtgcaggtgaactgacctgatgtgataaagtaagatagtaataaatgtttctaaaatgtgtaacatatacaaaaaatcaaaatgcagttggcacttggatttggtgcatcttgtcactgcttgtctgacacgtggagagaaccttgctatccctctcaatgcaggaaagacgttcagcttcttctaagaagccctgagggagtgaagaagagtccaggcctgtggtcaaatggccaactttcactttcactaactttcacttgagcaagtgacgaaaacttttggaaactcagtggtcatccgtaaatgtgaataatcataataatgtcatctcatagatgtttgagaaaactggacaatatgttgtataccaaaatctattaataaatcatgtgggttttagaaatatgggttaatattatccctttcagggtctttttctcctgcccaggtagagttgatggtaccctcatatctgttattgctgggccctgaacatcgctctgtactgaatgtgtcttatgatctcacagaatctttttcacctttggtagaccatgagctcctcttagttccttttttttttctttctctcttttttttttttgagacagagtcttgctctgtcactggagtgcagtgccgtgatctcagctcattgcaacctctgcctcccaggttcaagtgattctcctgtctcagcctcctgagtagctgggactacaggcacctgccaccatgcccagctaacttctgtattttttgtagagatgggggtttcaccatgttggccaggctggtcttgaactcctgacctcaagtgatctgcccacctcagcctcccaaagtgctgggattacaagtgtgagccacctgcacccggccagcttcacttaattcttaatccatctccatcgaagctaacacagtccatgatgcagattaaacactaaatacacgttggtttcctgcagcatttgtcaacttcgacactagtgccactcggagccaggtcactctttggacaggtgggggtgggggctgcaggggcgctgccctgtgtactgcaggatgtccccggcctctacccaccagacaccagtaacacctcccagctgtgaccagcagaaacacgagcattggcaaatgcctctgggggccacatcacgatggttgagaaccactgggctaatgaattaagatccactgagctcaggcaaggaggcaagagcctcttgttttacctggtgtttattagagagaagttcctgtccccagtgtctggggtgatgcttaaaaggggcccttaaaggggcctctatgctcatgaggattcctagttatggtttgtccgtaccttgtttggggtacattccccaagccttggcccatcctcgcttcctcttttcctcatgccatatgtccaacccatcagcaaagcacgttaattccaccttccaactatacccaggatgcgactgcctctcccaccctcccttgctaccactctcacccactctcacgcagatgtctcccatcctacacccacattttctcaggaagacttcaacacaggagccagagaggccctgcaaaatctaagtaacactatatccctcctttgcctcaagtcccctaatgatttctgaactcaccagaaagtgaaagtcaaagtccggcaatggccccacgggctctccaaactcatcatctattactcttcttcttggacactaaacagcagccacgatggcctgcttgttgtcctcgaacacctcaagctgacctcagggcctttgcatttagcattccctcctcttggaatattttctgctgtttaatcacgggcattctccctcaactgcctttgcagctttactcaaacatcacttttttgtgatcttctccagccaccttctttagagctgccatccgcttcacgtctttatttttctccttagcatttaccatgatctaacctgctgtgttttcataagtggtctgatgtcatgaccatcttcactgctagaaagtgaacttagtgaggcaaaacttttttgtatattttatcactctatcccaagagactaggaaagtaggtgctcaataaatattcattgaatgaatgaatgactccacgcataaacagtatgtctaaggccctgatggacccagcagatactccctactttttctcatctccatcacatgacaaatggcatgttttttaaataacatctataaaacatcctgctatctgacccgaggctggagttattcatggcatgcaatgaatctatcccagagagaggcaaggcccagatagcattgtctctcgctgcacaggcccagctgggcaaagcgccaatgtggcgggagggaaggaggtatttctcaactcaggcaaggacttctggggaacaaccccacctccgcgtagatcctcccagatcattcgctgggtgggtcacctttacccagctgctgggctttctcatttttcatctccttggatcgtgcaacagagcagtggttctcagactaccaggcatcggaatcccgcagagggctccttcaaacacagcgtgctgggctgccacccaggtctcttccgattctagggcagggcctaagaagccgcatctcaaacaagctcccaggtggaggtgatgctgctggtcccggagcccacgctgagaatcaccacaccgggggaaccctcactcaacagaatcaaacatggcaatggctccaggtggcctgcagactgggctgaggggggactcacagcatggcacataaattgactgagttccacctgcagtgagcctccaggtgggcttcacgaaatcgccatcgcctgtggaaaggggaaggtgccacttagtgtaagctgcctgtgatctggctggcctgagctggggatgctcagatggaggaaaagcagcctgctctgcacagacctgccagcctgctcacgagaagacagtttgcttgtggaccatgagtgagcaggtgttacctcttggcttatcctgctagtctatcatgacttgagctttggggacctcacagcaaattcagggcattggtagggagctcacgagaggctgagcaggcgctgaaactcccagccaggcccttggtgtggatggcacaggaaaacagctggttttagtttggccacacactgacagttctccattgtgtgaacacttggggctttctggtgcgtgaggctagagtgaagaaagggagagggtggctgtggaccaccgaagctgaaaaatgatgtcctgtgtctacacaacgtgcaattagattactgtctgcaagaatgctgctgtttgatctggcagtggccaagccaaacccacaaggacatcccagttggctcgcaaagcagtggttcctttctctcctgtttttcttttattatgctttacagaaactctattataatggcaacagatctcgtttcaccacttgtatttcatttcaggagcttgtaagcacgttaggactgaggttttgtagaattccactattcggttgggaactaagtccttcctttctctcaaagcacatggcctttttctccgtgggtactggatggatagggatggacagagggcactattcccaagctgggtattctaggcagaaggaggtgggccatgttctggaaagacctaagctgcagagagtgcacttctcccgtggaggtgtctgcaagatagtcaggggccacaaaggtaacagcccacaagttctagccaaagagtaatatttgacttacgtaacttccccttggacttgacttcaagtggcatgtgcactacaggaaagcccattatgcataagctaagaggagggacaattagaagaagctattgggccaggggccaggagatgggctaactccctggcacagctggcctggggcttccgagtctggaaggatgcaggtgcaggtagtggagcgttgaggagctgcactcctggcggggctcctccagaggcaggcagccacacactgctctgcagcatctcatctgtgagcccctccgtggcagaatctgcgtctccgtgaaccctgcctctgccctggcccctcgagctgggctgacacagcccggtgctggttcacggtgtccaaaataaagcagagtgaatcacgcccatgttcccttttatggagctgcacctgacattcgtaaagagcccatagtgaggccgggcatggtggctcacgcttgtaatcccagcactttgggaggctgaggcgggtggatcacctgaggtaaggagttcgagaccagcctggacaacatggtgaagccccatctccgctaaaaatatgaaaactagccactcgggaggctgaggcaggagaatcgcttgaactcgggaggcagaggttgcagtgagccgagattgtgccattgcattccagcctgggtgacaagagcaaaactgtctcaaaaaaaaaaaaaaaaaaaaaaaaaagcccacagtgagtcagcaaagcctgcggatgggatcccaggcagtcctttgtctgccccaaggctgcctccaacctctggctgagatgagtcttagctccactgataactgttcagctttcttttcccccattccccttcaggaagcccgttggattgttaatagcagaacactgactcaccacttatgtttcaattctttcagatcactgagcttgagcagccccctagtgaacctctgacctgacacgccaccccctttaccacccgctgtccagtcaggctgagctccagcagcagcggtgaactggccccccagagcacactggtttggagatctaaaaagtacaatgggtcaccagtcactgatgagtgcagcatccctggaagtcaggtgtgggggtcagtttcctgtgtcaacttggccaggccgtagcacccagtgacttaatcaaatgctaactgaggttgtactgggaaggcatttgcacaggtagctagtcagttgaacttgactaaaggagatgatgtcagataatgtgagtgggccttgtctaatcagttgaaggccttaagaacaaagcctgcggtttccagagcagaagaaattctgcctactttccagcctgccagcctcccctgcagatctcagacctgcccactcccacaactgcattagccaattccttcaaataaatatcttaaaatgtaaaaatatcctataagttctatttctctagagaatcccaactgatacaccaggccagcacccagacacaatgccaggagacacactgagctctgggggagacgggcatgagctctgtatctttctcttctacaaaggggattagtgtcagccactcctctccctccccctggaacatccttgtgggtaggggacgatgacacttggtgactggttgacatctgtacattgctagatgcctcaaagcggaggcagcctctgcagccagtgttcctcccctgcctattacaacccagctgcccttttcctcaaaggaggcacgtaggcctggattgaaggcagatgaggtccaccttgttcccttcatgaacagcacctgccaaaccgacatcaccgaacccaccggaggacccggaggatgaagaggatgacatgatggtcttcactcggtatccacccaccaaaacacatcaccgatgctttaggagctggaacagcattgaaagtttatgacggcagcaatctgggcaatgttagaattctatgagccctgagagaggaactcttaaagttcccattgtttccttgaaagaaaatgtcaaggccgggcgcggtggctaacacctgtaatcccagcaatctgagaggccaagatgggtggattgagttcgagaccagcctggccaacatggtgaaaccccatctctactaaaaatacaaaatttagccaggcatggtggcggatgcctgtaatcccagctactcaggaggctgaggcaggggagtcgcttgaaccccggggggtggaggttgcagtaagctgagatcgtgccacttccctgcagcctgggtaaaaaagagcaaaactccatctaaaagaaaaataaaaaagaaagaaaatgtccagttcccctgaaaaagatgtttcccggaaagagaccctcagcgcagcaccagcctttcacttgcctgacagaaaaaccacccaagagctttccccagtctgctgcgctgagggccctggggcggaactgccctggtgtctttcttatggactgaagctcctggtgtctttctttcttatagactgtagccccttgcctggggctcagggttaccccaaactcccaacctgtacccctggggtcacaacacaggctggaaaagcttccccatgcctggccaggagggagaggagacatcagctaccaaggggcatcacaggctcacactaaggaaaacagtgtttgcacttctcccacaaacagaatgcttatttttttattttttatttttatttttttgagatggagtttctctctgtcgcccaggctggagtgcagtggcgcgatctcggctcactgcaagctccgcctcccgggttcatgccattctcctgcctcagcctcccgagtagctgggactacaggtgcccaccaccacgcccggctaattttttgtatttttagtagagacagggtttcaccatgttagccaggatggtctcgatctcttgacctcgtgatccacccgccttggcctcccagagtgctgggattacaggcgtgagccactgcgcccggccagaatgcttattttattttaaattcgggagtaacacagtgagaacaatagaaactttcatttctggagcactgttctcgcctcctcactcagtctcccttcggaggcttgctgaatccagactggccccaggccagactctcaaacaagggccaggacatggctcactctgcctgttgtccatcggaaatcatctcagtgcccttttgtctgagatgtttccttcctctctccccaccttccaacatccccctcctccctgcaggtgaattgctcataggtagaaattagcctctgcagaagaaaagctttagaaatgtgtcccggtcttagtgtctccgccgtgatcacgctggcatatatgggatcatatgaccccacccaaaacagaattcattcagtgtttccaggctgtgttccaccaactgatctactgcataaacactgctgcattctttagaacatgattaccctgcattcttctgtgtttcagaaatatatatagttaatgatcaacagaaacattgtatcaaatgcataggatttatgggtaaaaaatatttacatgtaatcattaatttcccacaactttggtgtcctggacccatcattgcattttctatccaggtccttctgtaactccaggaatgaatctcttgatgagattcaaaaatatttacatgtaatcattaatttcccacaactttggtgtcctggacccatcattgcattttctacccaggtccttctgtaactccaggaatgaatctcctgatgagattcaagatgggcctgcctcgagttccacttaaaggaccagtgcggtggcaatatgtagcatcagagccagtgcactttcaagaagcagatgcacagacgcaaactgacttctcagagtggaggagtgttctggcatctcccatctccccatctggcacgtccagccttgccgttgacattccctctaggacactgtgacttggcaccttcattaacaccacactaggaattgacgcaaccgtttccagacttataaactatgacacttataataaacctttttagcgttaaaacatatatgtaacaaaaaggccccattacagcttcaacagagtggaaaatgctcagggtgtggagtcaaacactcctggtttaaatccaaactctgattccatttaagtggtgatttggggtcagactggaaatgcctgatcacaggtttcttcatccatcaaatggggtcaagtatacttcatgaggggctgctcggaggactgaggggctactggatataaaagggctttgtacacagtaaagtttccgaaaatgtgagctgttcttatgacctgatggtagattatgcaacatttcgaagaaataatctgttctttatcctaagatttgatattctttttcctgaatatatatggggtattagatcataattgaaattaattttacttttcaaaactacacagaattcaacactttttgagggccagggacagttctgcatttggtaatacattttacgtgacagttgtatgttcatgacaaactcagggaagctaataattatgggagacactggagagggctttatgtgtaagctaagaggaggaaaaaaaaaaaaaacaaacagcaggcattaagagaagaggaccgcagagatcagagggtggggtgagggtggagggcagacaatggagatccactagcaaattcaagtggcttggacatacgccgcactgcctggccactagctgacactctccctttgtgaaaacataagacggcattattttccaggcaatcaaacctcagatgaattctgccatatgtgggcaaggctcccctcccacagagccctcgtgcctgggaaatagaattgaacacatcttcaaagagagttcttggtaaatatactactaattttacaaactccatcctctacacaaaccactggagaacacattttcccagcgctgtccaacgtcaccgttcaatggcctttctttctttctttcttcttctttttttttttttttttttgttagccagagtcttgctctgtcgcccaggctggagtgcagtggcatgatcccggctcactgcaacctctgcctcctggattcaagtgattctcctgcctcaggctcccgagtagctgggattacaggcacagtggccttgctttctaagtcaatctttagagaagcatgactgacttccactttgcctttgcaaaggataggaaaatgggaggtcagggagagaaaggggcggaagtctccttaccttgagccattcacctggctagggttacattccattttgatggtgaccctggctgggggttgagacagccaatcctgctgagggacgcgtgggctcatcttggaagtctgtccatagtcgctggaggaggacgcggtcatctctgtcttagccaggtgtggcgttccgtaggcacactcaaacaacgactggtcctcactcacaactgataaggcttcctgaatgcccaaagaaacacataattcaagacactccaacagacagtcatgtttcaaaaagttgttgatttcagagtcctttctaactgggaccacattttagatcgtttttatggtctccatttctacctttcagaagaaaaaagtagcttgtttttctttcctcgggacagtaagagttagaaatgccagcctagaaaaacttttatgcaggtctcgaagcatcccaggcttgactgtggcagggcagcagaatatccactttaatctcaacttaaggaagttgaatttcaaaggtcttagaagacatccaattgcatgtgtcactatttgacaaatgcaatctataattcaagcagacagggtacagagcggtcatgaggattaaaaaaaagaaatctgaaggccaacacctaagcatctggcaaaattgccacattcctggggattttgcggaagagggacttagaggaagacagagggatcaatggagcaccaaagggcaaccaaccaaagatacaaacgtttccactctaagttattagccgaagtacagtttcaagtggtgcttccatgatggtgagcatctggatgataaatgaaccaaaaaaaaaaaaaaaaaaaaaaaaaaagctgtgaagtatccagatgcttccaaacagcaggatgtttaaaatatctggatcactgacaagctcttttttccccttactttcaattaatatcttcgctcttttgcatgatttggtgagaagaaatagcaatttgtcattgttggatcaatcatttttcgtggttttaagtcaaacaagtggttagccaatggctatgtttatattctacagccaatgagcaacggcaagtttgggaaatttcaacgacttaaatgatggcttgtgctgcaatgacacagagctgttgtgatacaatccaattttggttcttataacagacaaaaagaattccacatgaatgctcatttttatattagtcctttggcatcctcagtattgacatcaactagtgagaagcaaaggctagttgggccacacatttttatttaaaaaaaaagaaaaagaaaagaactttggaggcagagcaggggaggcaggggagtgtgggctgcgcagacccttccagtccaaacttgtcatctccaaatgagaaatctgagacccagaaaggtctagagctaatcttgaatgagctggccatgatcaaccaggggattagtgatgggaatgacttgtgtattaccatctgccttctccttgcccccacagccctatgatgccctttgtgacatttttttcctttgggacatgtgtttaaattagcaccctcttccccttctctgagatgacctttacataaataagggtgcttcccatcagtaatcacaccctagaagcagcccttctgagatggagagcttcctctccacccagaaggatcagaatttttaggaaacaatcacccccaactccacatctactctgtcgctcgatcctccacctgtcccaggaccaagttttttccttagcttcccaagtgcacaaacttctttgccagacacacggcactgagaatcagcaaggaggaagaatcaaaacaaactcaaacctctgtctctcaaagtggtggtcaggtgtctgtgctaaagcaaaagcccccatcctggactccataagtatctgtagaattacagccctgtgacaccctgggaaagactaagcctgctgtccaaacagtaatgcaaaatgtaccaaagagtcaggtaggccagacagagaaccagaatcaggcacaagggaaaaaagtcatcttgaatagacagcaaaatcaaactcatcaacaaccaaaaatgatacgaggcagtgacacagaagttgacagtacagaaacggcatcctagatgttagggaacctgaaattcatggctttctcttccagtcacaattgagtggccaaaacaaggaatctaaacacatagatgtgggtttcaaagtaaaatcagcaccatagacttagtcatgctaattaagacaaaaattagaccttattaaaaaatttttgcaaaacagatactcccttcccatggtggcactggctagtgtgttttacaggctcagaacaggaaacagagctgatggctgctgcctctctccttcctgggcctgagactcgaccaaggctcgcaggggaataacacactatgtaatgttagctttggctcacccatgatgagaaacatgaacaaatgtgtgatttatatcagaaattggcgaaaacaggttatatatataagaaacaggctaaatttaaaattacaaactaaaaaggaaatggctgcaacaataacaaacaagcaataactttaaagtattagtatttctccaagataaagtaagcttacttctgcaaacaaagccaatagccacaaaaatgtagtgtaagtttgaataataaaaaaaagaccaaaatattagaactaaaatgaagcttaagtgtgtgtttgtaggggaaggaatccattctcacatctggcaaagcattatttcagcacatggttttctaaagaaagaaatcaaagttaattgagatcgatttaggaaggaaaaaaccctcagaaatgctagagatgggggaggcatgcctcctttttttgcatcttaaaattcttctcacagctaatattgcacaaaaatgaggaagggaatataattcagaatattgaaagcaacccctcagttgcttttgttcattagaagggaaaaattctgaaaataaggaagcttcaggataaacacttcaaaagaggtgaaatacagtccacattttgaaaagacagagcaacccaaactatgccccaaagactttgttgattgtcactcaacaaaggctgctgaacacctaggatgaagtacagctcaggaaaaggaaacaaatgaataaagaaaatctctctcacatacacattttgggagtaagaagaagctgaggggttttcacagacccattcccacaacagcggtcactaaagttaagtgctgctcttcagaagcaaaccaaggcacagccctgccacatctttgtcctcccacttgacttggctgttggcaggtttcatcatcccttcggttaaagcttgaatggacacacgctgctgcatagggccctccctgcctggcagccctgtgacttcaaaggggagagaggatctagcccagtaggattaaaaccagaaaaagagtgctgaacacaggctgctaatcaggaccacatgagttctttaactccagctctgggagagacttcctggccttgactgacatgtctctccttccctgcagcctggctcctcctctttataactagcagatctcacctacctacttacctgcctgcctacctgccggccaaggtaggcagctgccttagttagcatgtatagattgttattgcagaaactctggccagccacaaggcttgggatctgcttcagtggctttataacagagaatattttaaacgtcaaaatctggcagatatgtggcataatcatttcatatgcctgcttctatgttactataaaaagacctgaactttagattggtgtttgccaatgtgtggggtgtttttttctgtagctccaggaaagttgggatattcccatcaggcaaatggcaggctaccaagctcatttttaaataacttacgagaaacacataattctaagcaaattacccccaaacaaaaggtactactgtgttagtactgtagtattgattatttcatttcaatacggaatataccaataacacatgaggaccattcctttggattttggtcatgggataacagttccagaaatgaagggaggtcccaccaggttatatttcatattataactctaaaatatgcatctattttcaagtaactagagtacaaaaaaggatccaaaatacattagaacactgaaaaagaaaactaacaaagttgaatgcatactgacattttcagcaaagtatttcaggaatcctgatgcctttctataacagatgaatactttgcaagatgcctatttctcaaccaaagtattagaaaataaaggcccaaaattgattctaatttgtgatccttatagctcataaaaatattacattgttaatacagagaatccatcatacttaacctcttttgaaaatttgggagtggtaaagtgttgaaactgagaaaatctttaagaatggtcaggtgaatttcacatctggagtaagcaaaggcatccatggtcctttcgtggttttcaaaaattaggaagatggccagaactaggcctctcgagaattggattatcaaacccaccttcaatgttttcaagtcttatatgctataattatttgataattatgaaaaacaaatggaacaactaagtggaacaagaattgtatgatcatgatcatgcttaaaaaaaaaaaaatcttggttcgggcatggtggctcacccctgtaatccaagcactttgagaggccaaggtgggtgggtcatgagttcaggagatcgagaccatacaaaaatccaaaaaaaaaacaaagaaaaaaaaatagccaggcgtgatggtgggcgcctgtagtcccagctactcaagagggtgaggcaggagaattgcttgaacccgggaagcggaggttgcagtgagccgggatcacgcgactgcactccagccgaggtgacagagtgagactccatctcaaaaaaataaaataaaataagaaataaaaaataaaaaaatcttaaagaagtccttgctgctatcacaacacagtgtggagatcattcacttaggaagccagcatcatcttcaatcaatagcctactttttctgtcagttttaatcccattacaatccaatacaaaacccttccttaaatttccctcacatataaccacgcagaatttggtacatcacttaactccctatattgccatcttttaaccactttcataaatagcttatccaccaaataaaccaggttaccttaagcactttcatgcaatatcctcttaaattctattttgttgattacaagatacaccacttgtcacattttatcagctctgaaatatgaaaatgaaaggcttatcctaggtatcaggcagcatttcttcttctctgatggcagataaaataatgggacattttatatccaatgacatcttacattttatgaaaaatgatcatttaatccttacaattgtcctataaggtcagctgtgattcttgcccacccatcagaaagtgcgattagagaagtaacatcaacagtgaggatgaggcagaaacagggtttgtgtctgtgaatggaatcattccccaaggctgtagactggccactacctggctgttactggaaggaagaagttggattaagaaaagtcacacggtggagtgttttggtgcctgctcttgccatgagagatggaatcacctagagagagacagagagagagaggctggtagagggaagagacagaagaaagatgaagggataagtgtccagaatccctggatctgggatggaataaaggatctggatggtaaacggagagtgctgggaaccagtaaggacttctctaggtataccatgctcttctatgagcctaggggatgtgtagcaatgggccctgcatacagttaatcatttcttttgcaatggcttaaatcaacaaccttgttcttttctttgattaatcagattattcagacacaaagacatggccaggtgttgggatgtgttcattgcaggtggatgcctgccttctcttaatgagtactatgcaggaaaactaggacaggtaggagtaccatttataaatatgctggagcctatgccactttgggcggcctttagtggatgtctgcagacctaaggatattggaaatctatctattaggctgtcgcaggctctattgtttatagtttctcttcaaggcagcacatatgcagtagatgcttctaaaaggtctagtatctaattgtatttggaggaggaaaaaacaacacaaacaaaatagacaatgcacttagagaaagctctgctctcccaccataagcctgacaaagatactccagtccttcaggagtttttattctaaatgtgtgcacttttgcaattctgatgccaccagtatctcattaaacaagaatcttcatctgaccagtgtgtcttttatttacaacacacaaaaaagcgaaacgtggtaagtgaaagaagcttcacaaagctgggtatgatcatttttgccccttcttgatatgattttcttttcttcttaattcttcagagaaggaagtattaacatcgtatattaaatgcagcatctagctttgtgttcacgtttttctaatttaacacattgcaattttagtccttcaaaactataaaaaaaatcttggattaacctcaaaggaaaaatgtatgtaggcaaatgaagtccatctaaagagagtatttctccaatatggtatcacttcagtgtcaaataatttcaccactcacaacactagtccagtgctaagaaatgagacccagaactagtgtccagatacatttgcacatacagatatacaaacacatacacatgcttacatatgtacacatatacatgtgtgcatgcatgcaaatacatacatgcgcaaatacatatatacatacacacacatatatacagatacgcacatgcatatacacaaatacatatataagtgtatgcatatatgcaaatagatacctacagaaatacatgcagatatacaatacataatgtatatacaaaaatatcatacatatgtatacatattactaaatacatactaagataataaggagagatgaaaatctttatccttattatctttattaatagaacgctttagaggactttcagatattctttatctttaatcatatccactagggcaaatgttgcctaaaagatacagagaacctggcttcttcccatttcacctctgctccttcctctctcatcctagaaggtgcttttccctatgctcagcacatcccttcagaacagacttagctggggatccatcccctccatgtccttcagccaattttcccggctctggactcacagactttctcagggctctgagaaggcctggctggtgccagcaattctctttgcccacatacttctcccctggccttgcctttattcaaatataagcattttcagggctggctcctctgtatgtctgcctctagaaataagataatttcttaacctcaaatgcttgttggtgttcatattagccctaggactaagacatcaggtgatattacagccccatcataatgctataaatgggatccacaaacttctattacatccaaatgaagagacgtgtttttgtgagatgaatggattgtgtagccaacgcccaggagttccagggagtttggaaaataattgccattggcaatatgtctgcagtcatactaccaaagagcgtattattgcagagtttcaccttcaatccacataggcttaaatagggacttcctatagctaagcaacctatgaacaaaataagacttactggaaaatgaacgtttgcaaaagaaggagggagcattcaatctggaaagcagaaactctagaaatattgtgaaagattggagcatggtagaaaaatgttaaagaaagaatagttatgtccacataatgaaaattagatttaaatgagccttgggagatcaagaatgtcaaccaacatcattttaaaacaactctgttttctcagtgccatgcagaataaacctcgaatgcatttgaaaggacaatgaactgggactctttgccctggcaaatgccatttaactgtttaagaaacaacatgcctgtgatgtgaatagcttcttattttcttctttaaagaatcgcttttttggctgggtgcagtggctcactccagtaatcccagcattttggcaggccgaggcaggtggatcacctgaggtcaggagttggagagcaggctggccaacatgatgaaaccctgtctctactaaaaatacaaaaagttagctgggtgtggtggtgtgcacctgcaatctcagctactcaggaggctgagacaagagaatcgcttgaacccgggagggggaggctgcagtgagctgagatcgcgccacggcactctagcctgggcaacaagagaaaaactccatcaaaaaaaaaaaaaaaagaagaagaagaatcactttttcttcccagtaggcttctttccttctttggagatgagcaaaaagtataaaaacatctgtggaaacctcctgtttgtatgttttacattggaatgggtgcaaaaaatacactcactattcctttacatccttctaagagggctgtttctactcttgacactcaatacttgtttttgtttctctaatcactgttatacgttactcacgaatattcatcaaaacccttttccttattttttatctagttttaaataattcatttgagataaaaagaagtttttctttgctttttttaatcactcagtggaggatgaacatgaagctgtaccaatggataggagaccgtctggtagagcacgggagccagggatagggatctgaagatggaagatgtgagtttcaagctgggctctgcccttgctctgggaatcacctgggtaaatcctttaaccctttcctgccccaagtgtgagctgagagcttgccagaaatgcagattccgagtctccagccctgctgagtcagaatctgctttgtaacaacttccccaggtgagctgggtgcctgctcacttcaacaagtgctgcattatccttttttgactctcaatttcttcaactataaaggtggtactgatggcaaccagctgccgagcagctctctcccaggacagttaaatgggccaaataatctagtgtgtgtaacaggtttcataaatcttaatattgtatttaaattatcatatgatagaagggtgatgtgactgactccaaacctctgcatgtgaaccatcagaattatccattctagtcatattattctaacaagccagatgcaaggaaaatcacagtctcttgtgtgcaaattatcacttattttttgtaagtactggattttcaaaccaagtatctacctaacagaggggaagggagatctagcatcttttacttcaagagcacgtctgtcactttgatttatagcctttttggtccctggtccagttcttttgtgggttttccattcaaattctacattagtttgtttaatgtcaattaaatcaaagctttgtgcaggaaggaatgaatcctggtacactccccagcgtgctgttggtattctctacataacaagataataaattaatagatataccatggtcttataacataatgttctttttctttctttctttctttctttctttttttttttttttacctagaatagcacaaggcacaaagttgatagccctcaaacttctgaagaaaagtcttttcttccaggatgtggaatccataatgctttctatgttaactttccctaaaaattgttgaatttttcataaacttctatgaggaagtgtttccatggcagtctggctaagaggttcacaccatcattctgtcctggtgatttttgaaacttacaagcccaggttgaaactcaggtgattcaaggcttgagaaacacaaaggccaagctcaaggagtagcaaagttgcttgcactttttttctattggcatggtccttctctgaacaccagggaaggggtggtgcaccacctctctcctcttcagaaggagctccgtgaaaaatcggcagttttatgcttggccctttcaaaacacacaaaggctaaaaatacagtgtgctacgcatctggaatgtgtctcatctgtgaatctctgacacatggattcattgttttcgataaaattccaggaattttattcatgagaaaattctggcacaatggaaaaccctggcaagcaaaagataggggcagcagatgtcctggcctccacccacaactctgtctctgcttttagctaattttcatcaggtgtcactctcatgccttcaaacactcaattcaaaatttcccataagacgggggtgagggggtgggggtgtcaaaacagccttaattttttaaataattggtacggtcccccccctccccacagacaggtgtgtcacaccaggttcaacatgcacgtgccaggatgcaggatgggcactttaagaagaagccgcaagaccacagggccactggccatggggctccaccactccgtgcccctcatgtaccaagtcttcaagctcctcgtctaaaatgagggtctggtctactgatgttttctaagactccattttgcaccaaaatgagatcgatttgtttaactagtaacatcctctttcagccatagccaggctgcagtctctacctcctccatctctgagcagacatgcagataaggtagaaatctaccatgtatggagttgctaaaaagttcctatgcatccaggttagatgctaactgcagggtctttccctgctgcccccagactttaattttcctcaatcttgtaggtatctccttctgtgctaatggtaagaagctagtcagcaccctgagagctagtgttatgtttttaagtgtggaaaggatctactctcttgcatgggaatatggcatctgttctacacataaagcacttcaataataataataaataaaaaaatttaaaaaataaaaaacacatggcaacatggtaataccaacagaaagtcttgtagaaactggggttctggcagacagaggagcacatgaataagtctccactattcacatgatggtccaggggtctccttcttttgctttctatccccatccccatcattgttggcatgggccacacactgtataacgcagacatgaacacagacgttttctttttcttagacgctgacttacgtagaaagagttagtcttcacccactgtgagggtccaatccctgccaaggtctttcttcagcttggtaagtgatgatgtctgactccctggggctgggatgctaagcctgtgcttttcagaagatttttccagcacataaatatatcctggttgctgcatggaaaggggactaagtagccaggtcatcagagccctttgctaatgttatacgctgagctcatgcttttcctatgacatagatgagcactgggtagaccccgtcctggtaacacttttcatgcactaacaagttggttgccagtgagacttgatttttatgactctgggagtgctgacctcaaaacctaatacatttgaactaggagagcaatccctccaacaatttcaaactacacatacttacatcacatccaatagggctcttttgccatctggcttgagcccctctataaatatgtctactttgaaagtcacaagcctgggcggggtggctcacacctgtaatcccagcactttgggaggtggaggcaggcagaccacgaggtcaggagatggaaaacatcctggctaacatggtgaaaccccatctctactaaaaatacaaaaaattagctgggcgtggtggcacatgcctgtagtcccagctactcaggaggctgaggcaggagaatcgcttgaacctgggggacagaggttgcagtgagccgagatcatgccactgcactctggcctgggcgaaagagcaagactctgtctcaaaaaaaaaaaaaaaagtcacaaatactctttgaaagtgtgcagagtcattcatatccaaaccatcaaggcctgcccaacagcctggtgacttgaaatcttgacgtgtacacagagtctaaacctcggtctttagattgcctccttactggacctctttacttattaagattcatccttgtggaggaagtgaggtcatggatgttcacatctatctttcccaggaagaaaaggaagcttcaagagctgggaaatgctatgcaccactgtgcaggttctgagcagcacagagccacctgtggggtgggcgggtaggtgagtagtggacatctgaccaccaggcgctgtgcaggactacctccttgcagagcaggtggggccttccaagttgcctactcatccaacctgcacagtaagccttatgggagcgtcatggggctacgcctacttcaaagagcaacttagctaaagggaaagagaatttgcacttgctctcttccactctagcagacttgcacttgtcgctatttatttgtgaacacagactcattttagattgacttaaaaataaaaaaaagtgcaaagaacagggcagctggaagttgggaaaccacttctgccactgctgaatctgaagccttaagctcctgaactggaaaaccagccgactggagcactgagctccctgggccctgtaaaagagcacactggccaggcatggtggctcgtgcctgtaatcccagcacttttggaggccaagacgggcagatcacgaggtcaggagttcgagaccagcctggccaacatggtgaaactctgtctctactaaaaatacaaatattagccaggtgtggtggcgtgtgcctgtaatcccagctactcggtaggccgaggctggagaatagcttgaacctgggaggtggaggttgcagtgagctgaggttgcgccactgcactccagcctgggtgacagagtgagactctggctcaaaaaaaaaaaaaaaaaaaagaatgcaccaagtagtggccagtcaggctcccatgggccttgacacgtgagatgtcaggcagaatttttattaatgaatctgatgccaattcagtatttctgcaatcacaatgcactttcgcaatatttatccaagcaatatttatccaacaaaaatatccaatatttatttatccaggatctcgcaaacgttcagtctagtttcactcacgtcagtgtctctaaccttcatactttgctttcaagcaagagtcgtgtgttggtctgggtgtccgaaggtgggggtggtagctggtgatgcaaggaaccaaaaattggccatacttacttacttaaatatttcacagctctttaacagattctcatctcctgctctcttctcttctccaaccttgccgtctggttctgacactgtcctgccacgattaggagtgagctttttggggttccctcaaacattcactcccagctggtctctttgttacctactcaagagcagttcatactgttggccactctccccttttttaaccctcttttctttggcttccatattcctgctattcctcctatttggttgacaattccatcccccatctctttatgccctcctttttctctcctcattctctaaatgtcagctttcctctgtgcactctcctgggccacttctctactaggctatcatttcttccaagccatcactcaggagccactccaatggcctcagcgctgccaggaagcgcagcgcatttaatttgaagggtgaaactgccttggagggatggcaggtgcatgcttaataacttgtttcccaaggccacataagtgtcattactggatgataattatcagctcaagagggaaagttctaagacagagaatgcaagatttctaaacaggtctaagacagttttccaatgtaagatttattatgtaacagttttgaaagtagtgtctgattccctgtctatatcctccagaacaatctgagggcatggttgccattacaatttactttgggggacgattttatagcacgtcttcacagacaacacgacaaacatctttgcttctgctacactgacaacctgaagttaacatttctgtacctatgtagccattttaatcaccccctaaactggttattccacagcccaggggtgtgggactgagtcagatgggctagagatacctttattcagaggatttagaagtttgcctcagagaaaggccatttctagtctccactagaaatcacacatatcttccaggaataagaatattctcttagtcataagttcaacaaatatgtactgaacaccttttctacttagaaacttgtctagctgcttctagattacatccatgacccaaaaccacaaagacacctatctgcataaggcttgtattctagcactacaagccacagataatttttgaaaatcaattaatcaaccaataattgatagggtaaatttataaccttgtttttcaagcctgatctcagggttagaaggtggtaagtgataagtatgaagaaacagaaggcagaactagagactcaggaaaagagaggtaaactgctgcttttcatttagagtggccagggtggtcctgagaaaacgcgaaggaggggagggtgtgagcccccatgcattcatgaagaataggccttccagccttggcaacagctagaacaaggccagagtggactgcgggggctgcacgaggaacaatgggaccaagaacagccagggaggaggggttactggaaaggagcgaaagaaagaaccaggaggtgaaccaggaaaggctgggggtggtagagccttgcaggccatggcaggaacctgggtgttgactcagagagaagtggagtctctctagccgtcttggctaaaagcccgggaattgtcttcttctgtgttgcactaatattttccatctcataagggttctgcaaagaaaattctttctatctttaaagttttattattttcaaaactaaatgtgatgagaatgcatatattgcatatgccatgtgtacaccaaaagccacacctaataaaatgttacagccatcctttgtcccacatgcaacgggaacttccattcatcatcacatgcagaaactctgggaactgagaatctgtacttttcattcagagtctgcaaggggtcacggccattttgaaaggctttgactcacacaggaaatacctcactgaggctcccacccacccatccactaatagggcagcctttagggaaactgacttgtggcaactgaaaggaataacggcaccaaagtattcccctgccctgaaatctctgtttacctgtggaccggtgatgggtgtgaggctgtaggttttaacgagctctgaatggcaaatggcagacaatggtgtcacttcctttctgcttaggaaggagacgtttggaaaaactgttcactgctgtgcttgcctatggagaacctggattcccagagctctatctggtagaacgtgtctccatattaataagcagtgaatcctcttttgcggctgaattttcctcaaggaagcagcatgggccttattactgccttaaaacccaatttcaatattcgatacatagtctgtgtattcatttgctagggttgccaagacaatgtaccacggactgaggggcttaagcaacagacatttattctctcatggctctggaagctggaagtcagagagcaaagtagcagcggggttgattcctcctgaggactccctccttagcttgtggatggtcatcttctccctgtctcttcatatcatcctccctctatgcatgcctgtttctgagtccaaattacctctttttataaggacatcagtcccactgaattaaggaccaccctaagggcctcattttaattggattacctctgtaaaggccctacctccaaataaggtcccactctgaggtcctgggggttaggacttcaacataactcagggaacactattcaacccataccatcctccaggaaggcagagaatgtgtccctcttcttcactgctgtatctccctgcctagcacagtgccaggtaccacactatgctctgtaggtcagtgattctccggagctctgtaggtcagtcattctcaaagtgttgtccaggaaccccctggggtccccagacccctctaagggcaggcataagcagatctgagaatccagctgcctccaattagcccagacattaaagagattgcaaaaaatgcaaaacaatgccacttctcattaacattttcttggaaaatagagttacttttcataaaaatatctcatttgtgttaacatgcaatgagtttatttatttatttttattttttgagatgaagtttcactcttgtcacccaggctggaatgcaatggtgtgatctcggctcactgcaacctccgcctcctgggttcaagtgattctcctgcctcagcctcctgaatagctgggattacaggcgtgtcccaccatgcctggctaatttttttttctttttctttttcttttttgagacggagtctcgccctgttgcccaggctggaatgcagtggcgcgatcttggctcactgcaaactctgcctcctgggttcatgccttctcctgcctcagcctcctgagtagctgggactacaggtacccgccaccacgcctggctaatttttttgtatttttagtagaaacagggtttcatgatattggctaggctggtcttgaactcctgacctcaggtgatctgcctgctttggcctcccaaagtgctgggattacagtcatgagccactgcacctggccttgttattgttatttttaaatgaatttataagtaaatgtttcaaaatttctgtttttgtttctaccaatagatataatgcatatacacaatttttttttaagaatcctcaaccaatcttaagaacgtaaaggggtcctgagaccaaaagattaagaatcactgccgtcgaggttttaagcttggctaggacacagtctgtacttactgaagtaacccacagtatgacagtaataagacactttatgaagaacatattttcagtagctaagtgtcatagaaaaggaagcttgttagccatttcctcaagttgacaacagagagtccttaggaaaataattttttaaagccaatattgagccttccaagactgcacatggtgatatgttaaatttggaatttatgcaacttaaaaaactgagagtcgggggttggcatttttgtgcatcctaactgacgagtgctgccccagggctctctaacactgcacacagtctactaaagaagcaggctgcccatcatgacccccacccatcagctacacagcacacatctgcttctagatgaaccttcttgcaagtggcctgtcttatggcaaaatcaaggggcaggcctgtaaagcggaccaggaaatgagcagcaactgcataccaccaacctgttgccaagctaactgtgcttttctggatcagaggcagcttgagacactggtccctggggctgagggactgcagagcccgggcacagactccctgcctatctcccagtgtgtccatcttggtacacctggtgcatctctggattggcaagtggcactccccaattaatgttaagggccacttgttttaaatataaccagattattttaatttttaaatgtgtatcccatacttggacactgaaaggtcctccctgtttacctgcttgctggggtctgtgcttgggtgtctcattttattataaaacagagtctcaaaggcatttaatactaagatcaagtggctgggcatccatcatgtgcagagcaggagcctgatggtggtgaaggctcattctgcatgtggttgactctaggaactactttaacagaggggaagaaatacactgggagaaaggagcaggagattcgtcagggctgggggaatactggctccatgagggcagagacttttttctattttttctctttttcagagcctgtaagtgtccacatatcatgcacatgcagtgcgtatttgttgcatgagctcctggtatgcaggtgccaaatgtcatgctaagtgtgtcgactggatgacagaagaaggaaggagggattaaaggaactggtgtgcactggcctgagccttgaagaatggggtgtactgggtaaatcaaaatggtggggagcatttccagatggagaaactgcaaggaaaagcatagaagtggggccacccctcgtgagctggggagggcccagggtatgtgtgctggttggggggaagctgaaactgaggaaattcccattggatccatagcctggttctggtttccacaggcctgggatgccccgtccagagtttgactttcagtctgcacgtaatccaggctttgtattcccacttcccgtatcccctcactcctttttcacacaccctttttatctatgatgctactggggtcatgggttaagaagtcctgtcgtctaagcagcaagggtgcatcaaagcaggattttctccattgattccaaggtgtgattcagaaatggtaaaaactccgaacactaggatgagcactggggatgggttcatgttttttttttatgaaataattcagaacttattaagaattcccttggcaaaccaaattaaatattaaacaactatttgttaatatgttactattggattctatcttagaaaagtgtaattatgtgtaactgaactttttgttttcttgtggttgaaccctgaattaccatgccttctggtttccgtgtttttcctggggaataggtcatatttcttacttccaaagcccagaaataaaagcctcacacatccatccgtagtcccaaaggcttttctgcctagtacccagagagtaacagcagtgcttcaaactatttgtggacaagaagtcctaaaacatcagacacactgtggaaagcaatttcatttcattaatacaattcataattaactgcatttattttattgtctaaattccaactgctaacctatcatatcgacgaattctttgaagttgcctttattctacaggatatgttcatttttagataatgctatttttcatatactttaagttctggggtacatgtgcagaacatgcaggtttgttacatagttatatacgtgccatggtagtttgctgcacccatcaacccatcatctacattaggtatttctcctaatgctatccctcacctaccctcctaccccccgagaggccctggtgtgtgatgttcccctccttgtgtccatgtattctcttgatcatctcccacttattagtgagaacatgtggtgtttggttttctgttcctgtgttagtttgctgagaatgatggtttccagcatcatccatgtccctgcaaaggacatgaactcatccttttttatggctgcatggtattccatggtgtatatgtgccacattttctttatccagtctattgttgatgagcatttgagttggttctgggttcatgttttaaaatctcaatttgctccctagtcctaggaatgatcttctccacctccaaggaatgcaagccccagtgcaacatggattcttcctctgtaagaggctagactccaaataatttgtcctgtttttgcctgtgggatgttacaagtgtaccctgctgtctgtaattgtgtttctgaagtgttctatgtaagtaggtttttgttagttgaattgtactttaaatgtgccaatcaagttccccatgaaaagagatgggcacagagactttttgaaaaattaagcatcccaagagaaaagccgatctgaaaagactacatattatatgattccaattatatgacattctggaaaaggcaagactacagagatactgaaagatcagtgtttgccaaagattagagggagggaggggtgaacaggtggagcactgagggtttttagggcagtgaaactattccgtataatcctataatgttggatacatgtaaatatacatttgtccaaacccacagaatgtccagcaccacaaatgaacgctaatgtaaactacaggcactgggtgataatgacctgtcaatataggttcatcaactgtagcaaatgcactccgatggggaatgttgataatgtgggcaaggctacgcaagtgtaggggcagcaggtgtatggaaatcactctatcttcctctcgggtttgctgcgtactaaaattgctctgagaaataaagtctattttttaaaaaatgaagtattccaattaatttataagttttgccacacgtgcaatgacggccctaaccactttactttggttctccgatactgaatatgtcactgtgaatatctcatcctccttgatcccatccccatcaaaactagagattgaaataaggagatgagatggccctccctgaccgccttgtgcctttcagaggaggtgcctgggctggaatggggaggagctaaggactcctgtgggattctgatgctgggtgtgaaactgtctgcagttagcacggtgttggagagatgagtgctagactttgtatttctggggactagtgataaatgctcattattatttatataattttaaagctacgtttaaatttgtccccagtactagagactttaatgttatattgaaataatacataataggctgcaaatagttatattcttgtcttgttgttgtccatgtatcagcattcttgtatgaatgaaactagaaccaagaagaaaatccatcactacaataatggtccatacattaaaacagtttaggctgtctgatggtctggggtgtgtgtgtgtgtgtgtgtgtgtgtgtgtgtgatatagatatgtatgatatatatgatgtatatatgatttatatatatataaatcatctcatcttgctcaaaacaatatcactcttatttaggtaggcacactggaatatgattttaattaattgaaaagtacagtttgtttcacatttgcaggagtggtttaattcctacacagtgtactaagatggcctctcgtgggctcatgatcctggaagatatactcccaaagtgagggggggtctatgttggaagcaaaaataaaaggaatttaaagaatgacaggtctgggaaattattcttatggatggtcagttcttcatatgataaaatagttatgacaaaccaaacaggcacagtctcatgtatgcactgatttgcatgaaccaactttacagataattgattcagttggttggaactacagtttcttccaaatgtggacaacttacaacagggtgggagccccaaactgtgaagtcatgtgaggtcatatacaaactgaaaaacagggtttctctactggaatgataatcctaccatgttacacttttccccaaaatgaaatccaacatctttcacctggcgtaagaagcccaacatgttctggcccctagaaacccttacatcctgcaaagagggactagagcttgttactcttattagctactcttaaagtcacagaggtagttaatttggcaaggagtggctacaaattcaagacatgtttggatgtgctgagaatcagaatccaatctcggccctcaagtcatgggttaaagacttggttttttatctatatgaggtcctaccttgtagttcaagcagaaacatccaacaaatgaaagcagaaacaacatttgacagctcaaattcaaaagcaagaggcttgtcaatgcaaaagtcttgtgctgcaaatgtttcaagggaagtatccatactctgaagtgtgcaattgaaagaatgacctgatattcttgcactgttgcctcaaacaaacctccctcctcctagctagctccggatcttttatgcatcatatagtacatcttcccaaaaaagcaggtggaaaccaaagtgtgcaaaaacacacattttccaagaacaaatgcattatactagcaagttatgtgtggtggggctaggtgcttctgcgggtgtggaggaggaggagagaaagaagggtcaggaggaagtgtgttgggtacagagacatggaaataagaaacaggaaccctgaaagacacacccgcggaggttctgtaactgtacatgtgctcttgttaaatcgccagtttcagaggactcagatctgaggccatatagaaatctattaatttgcatcttgactttggggcttccagtaacagtaagtatttgtatttcaggatccactcagcagaaaggccatacatattcaagtcacataataaattggtgaattccaagtgaattgtgaataccaaaaaagaaaactgattatgtgactttctggaatatgatgtagaaattgacctaacaaaatgtatatgcacacttacggcatgtgtgcatgagggtgtcatttatgtacacaggtcatgtgcacatccaactcatggccatgcatgctgtagcctgttacccattctgggagatatgtaagcctttgtctttctccctccagcttcctgccttcttaaaacatttcactggtcatcaaccaatgattgaagctgggtgcagaaaaggagaaaaggtgaaaactcctcttagtccacaaggtgacgtgttagtgcttcaagtgaaagggctgtggtggagagccagagaaagcccttaggtggaatgagactgtggttcctataggtcggcaccttcctccccacccggcaggtcagctcatcaattgcacttatctcccagctgccacagcctgtctcactcctttctctctcctgttgggctgctaccaggcctggtaaactattccgtagctctgtgcaatagaaaatagatatgtatttctctgaatatagagagggaaattggagttcacatggaatgcatactgtaaacttatttgttttctgaaagcaaaaattaaacttgaaaggagcaaagcttttcaaatttcccatagtgctggcctcaaatcctaaagatttttttccttgacaagaatcatgggatgaattggaagatctggatgctccattcaccacagttgatgatgctaaaacccatgtgacagcagaggaaagaattgaacattctaaagtcccctctggcaactggaatgccaggggagccttcaccatatacctcatcaagccaccccaacaaacctgccatgtcggtgaaaagaccatgctcactatgaaaatgtggcttctgccgggtgcggtggctcacgcctgtaatcccagcactttgggaggccgaggcaggcggatcacgaggtcaggagatcgagactatcttggctaacacggtgaaaccctgtctccactaaaaatacaaaaaattagccgggcgtggtggtgggcgcctgtagtcccagctactagggaggctgaggtaggagaatagcgtgaacccgggaggcggagcttgcagtgaaccaagatcgcgccactgcactccagcctgggagacagccagactctgtctcaaaaaaaaaaaaaaaaaaagaaaaaaaaaaaagaaaatgtggcttcaagaccagaactctagccctttgtccaaaaaaaaaccatagcccccgagacccctgatggccttgacatgccactgggggtccccttatctatttacattatagaagggcttctaagaagaatggtttcagtcagagaatccaagcaacttatgctaaagtccagcctcatcctcagaactctgggcatgcttgtttttaatgccatgtctatccatctgtgactcattaacgcacttagcaaacactgagtgactgactagtctatctctccccgtgataaaatttaaacgcctcttacaagacatgagtagtctacctacctgttacttgtatgccattacctgaaaaattcccatctgtttggatgcaaacttcacagaaactctgccacaaatgctcacgaacaccatcacatgggctgggctctagtgctttggaatatcctactttcttagaaaaatcgatgagtacatataaatataattagctgcaccttgattcctgcggaatcattgtattaactgctttgggctattctccttctttcctttcaggcaatattaatttgtaacaaacacattttatgatataataaattatctttcattttttactatcaaatacatggagaagtaaaaaaacaaaaaacccagaacttctaggcagctcttaaacaagtcttgctgttacttggaaaagtaacaaattcacaggtttattgtctatgttaataaagctgtgttggagtagtcattataaccttttacattccctcctgtttacagctcacagaatatgtttacacatgtgatctcattcagttgtaacatgatctgcataaattatgggtattaacacttgccatatttattacaacgatttccccagcaatttgtcttcttaattgtataatctatattgcaaacagatgtctgcagtttgtatatgcagctatgtactcctatggtttatgcatctacctcaggccattaaactgtaagctcctggagggcagggatgtatctgattcatttctgtatctccggaacccactgcacagctgctgaatggatacacatctagttacttaacctctgtgtccttcagtttcctcatctgtgaaatggctataatgattgcaggaacctgtcttctctgtcccaattgtattaagcaaaacacttaatacaatgtctagcatataataagcactctatgagtgttttctattattattattattattattattgttataattatctggagttaattgaattaaagttcaaaaagatgacctaactcatttgggggaaggtgatgaataaacggcagaaagaaaggaatatcagggatcttatatgctgatcctagctttgtctaatctgccaagctaagtcgtaagatttttctcttttcaaaatacttctgttaagctagtaaaaattatttacttgtaaagattccatgtgctgctttttctgtcataattgcatttaccttaccaaatacatattgaccatctacacagtggatagcagaggggccacagaaatgagtaaagtctagttcactctgcactggtatctcttttcttccatatttacattttataattacatttgtcaaactgcttcacaggcgaagtcctggaccaggaaccaaataaaattgacccagctttccgaccatggaaaactaaaagtataatcaactttggcaccattaaattctgtttcatttattttttccaagagtctattaacattgtcatacagaagtagaagatttaattgagtgtgtgcattttgagttgaaagcagatactaacaagaaaagctaacctggaagacatcttgtaaactgtttcatcagactggaccaggagccaggggagggtcgaggtgactcagggctgttggcaaagctgcagaaattgccactgggtttctctgtcctctaggcaacctaggctgcattggctctctggcctattattcattacggtttagttcaccacagaggttgccagtgagcagtgcataagattagagattttgtaaaaacatgttaatttgtatgaagacgaaaattggactatggagtttagtgataaaaatagataaacagttctgtcatttgatttaaatattaaaataagacaagacaaagcttttaaggaaatgaccacttcttggttctcaactagaggcaatgcctcttctgtcctgagcagatgggtgtttgggaatacgtggggtgacttgggttgctgtgataatgcaggggttctctggcaatcagagggagagggaggggcaccttcaaactgtggtccagatctacacaatcaggaaaggctgttcacctaaaattcaaccttctgttgagaagagcaacacttacggagctcatcaaagaacgacaaaccactggaacagttcttgagaccaaagtctcattcactctgggacatatccagttacataaatcatttatgttttatcccgtctctactttcccaagaaaccctgccacacattcatagtgaatatcaaacctaattaaagatcctaagcagctgagaaaattactcaatgaccaaactataattagtcttctacaagggagaaaatgtattcaaatcattgcttaattttgtttcatttcctcttacctgcacttgaccattaagatcaaaagtctgagaatttgtggccaaaaaaaatgaacatgagtcaaagtcacatctatttgttaataatggaaagtaattccttttctaattacacgtgaaaatactagtatccaacaaacctatttgtggaaaatacggtttagattgggaaggttaattactttcaggtttttcaatgtccaaaacacacctcagaactaacaggctcagacaagatctttatgagatcactggatcctccctccaaaagcttccccctcccctgttgatctctattccatatgctgcttcatttgatcgtatagcgtgtatgatgagcctgaatgcgggcatttgttgatttgagtattacctgaaacaaaagatacaccagaatgtaaaacccaggagggcagagactgttttcccagaacctagaacaactcctggcacataccagatgtaaaatcattgtagaaagaaagaaagaaagaatgaaagaaaggaaggaaggaaggaaggcatgaaacggtgcactattattgtatgccaccttaagtcactcatagaaaatactgcatgccagcactctatgcaatgggtgttacactagccattatgtaaagtcaatgacgggattatacgctgggcactttataatttaataaacacccttcaattaccgtctcatttgctcctccatgccactccacatagtatacgggacatattttaggatcaccagtttagagataaagacagaggttgtgtccccaaagtttgcttgcgagtgtggtatttgtaacttctaaaactctaactctcccctgaaaacacgtcctaagagtggtgaggctcccacgtgaggtggcaatattggttacccccgctgagctcatcacattgcgcaggcctccacagggcagctacactctacgataaggaacatgaagccctgagagtcaggagggagaaaaaagaaaatgaacgtttggaaaagggcattcccaaatcacaggagaaggggaagaaacgtgtctcagctactaagtttctcttttccatgacgctcaaagcagaaaatggctgcacgtgggcaattcgtgcgcttggagctcagacctgcagtcttgtcgtttgtctgccctgtcttggtgcatgctgggcctgacttttttatttttccatttcaaggagccccagcagggcctggaggaaatgagttttgcagcccatctcggcccttgagcttggctcctcggctgacctcggctccccgcctgcagacccggcatgaggcaggcagcaggcactgcggggcagaacttccgggacctgcaagaccagtccgctgccttctgagacgtagttctgaggtgtagcaagttttcattttcacagcataaaaccgtctacaaatacatacttcaaaatgaaatggaggatgcgctcaaaaaaaaaaaaaaaaaaaaggcttagagacacgtcaaaagggcacaggagctcagccaggtcaaataaattcccaaatttgactcacatcacttcagcctcatctggatattacccacactctgcctaggcaggcgaagcttccgtgggatcctctgtctttagtgaattctttcctttatcttgtccagcttttcattgctctttcagaaactgagcccatggttttaaatcttaatatgaccttgcattcaattatatatatacatatatatatatatacaaagctgttttttaaagacaattttaaataagaaaaaaataattattttagataccagagagtggtgaaataataatgattcaaacttaatcctcacttcacgtaggggaaattgactcaaatctgggagcatcaaaaattaagatgcatttacaaatcctaggagaagatatcctttgtaatctcagagaaaataattgagagagggaaaattttttttgaaagacgtggtttggacatattactattttgtgaaatgaagttaaatgtatggtacagatattaaagttcacttaagttttatctatataaagtgtgtgattttggatctaaacaggcataaatatatatatgtgtgtgtgtgtgtatgtgtacatgtttgcgtacgtatgcatgtgtatgtgtacatgtttgcgtatgtatgcatgtgtatgtgtgagcgtatgtgtgtgtaagtgttgtatatgtgtgtatgtgtgtgtatatgtatgtgtgtatataataggaagtaagttggaaaacatgagccaactgacttttttttccttagacagctaaagaagagtggttagaagtttactcacaagtaaatcttttaaggagcgtttacttcccagaaacagcaatgagatcttggaggggcaattcttgtcaactgtgcatcatcaatggagtttaactgtgagaggtaaaacccattgttggtcccgactccaccaacccaaatggtcatatctgaggacttcctgtggttctcccgcccccaccctctccacggcatttactgctcctgtataccctggacttctcgacaggaaatggcaaattcctcagtaggaaagccaagaagtgggaggtcacatggagactggaagttcattgcgtgcagcccctccaggtgacaggcgacaccgcctctgcatgttgagtgcctttgtgacacatgatctccttgtctcatgaccacaggcagcagggtcctgatgagtgccctggagagaactgtcctcccacccctgggtgacacagagtctcagaagccagcagaggtgctgcaccaaaggctcagactttcaccctgcctctcttctcctcaactctttgccctaaaaaacatgtgctttgagggtgtgttgaaaatctcactaagtcaaatgatgcctgtggggcagaaataacccttgctctgaaagggtcaccaaaaagtcatgagactcctacctgtatggaaggtggtgactatatagcccttgtataaacaaacaaatacggtgaaagacttggctccatttttttttttttgtctgttcgttattttttggagaaaacgttgtgataagaagcctttagcctacaaaaatgtctctagattaatgataatttatctcacttttctcagtgaaacagatgaatcaaagaaagtgaagcatcgtagacaatataggaccttcctgataacatctaacatttaataacgtgatcacagcgtggcggctctaaaagacatgcacatgtgaattaatgcatctaacctgcacactagctaccattatgcccattttaaagatgaggaaaactgagactccaaaaattaaataagttgcctagagcatcttgccagttaatgcaccagaattctaagccagctgcctggttccaaagcgcatgcccataaacgcggaacataatgcaccaaatggcctagaactgaaacgactgcaaaaataagtcaacatatgagaaactagagaatatataaagccagccccaccataatcagtggcaagggatgggagatgggaagaagggagaagggaagggaagctaaataatttcagtttttctctgtgcctttaattcctgtcccctgaagatgacacgctcattttagtagcaacccatgaccaagatgcattccccaagcttttcgcacctgacagaaagggactcggtgtccaggactgtgcccgattacaatcaaagcagatggacccttccttagggtagggctgttcttctgacagcctcctctgtgaaactagattataagaggatgtgctgctctcagacaccctctgcctgtccccgccttggggtccttgcctttgccattcccctggtccgcatcactcctccgaggcatttgcaaaccttgttctcaccttttctttgggtctctgtctgacaggccttgcctgatcatgttctctaaactagaggtcccgccccccggccacctggctctatcatgttccctaccttccctcctaaggctcctgacttcctgccacactctgtcttcgttgagctgtgatctatttgtcagtctcccccatctgcatccccctgattgacagcactgagtgagcccagctgtcctgctgctcatgcccctcagcacccatgagcctagtgggtgcccagtaaatccttagtgagtaaatgaatgagtcaatttccacacaccaaatcccaaagggataaaaagacattgcctttctgccatttcttggaagaattttttgagacaaactaaagaaaggaagctacttgttattaaatttttaaaaatctgcctactattttcaggcaaatatgtcatgatgacatctatgaaatctctgaaattaaagagaagcctgacgtttcacaggaattaaatgaagttgctgcatcacaggtgctccctgccacagggctccgtgtggcagcagcaaacagaactcctcgctgcttaggtgtagtccttaggaatgaaaatctgaacgtagtacgttaaaaaaaaaaatcttcaaaagcaaacaaagccctaagtgtcgctgtgtattatcagggcagggtcctcctcagagagaggcgggctgcaatcgcccctacacctttcaccaagtgcctcgcttcaggggtcccattgtctccacgtttaggtttaggagcctggctcttcgtaacaccagcgaaacatgttctcctaaagatgttccctgagatacaacaccactccgcattgtttcaccacataccagcattaatatcccagagtaatccaccctcctcttaacggctgatgacggctccaatggccatgcaaaaatcagttgaaggaaagggaagtcttgtcggaaatgagattagtcttgtaacgagtgttcagccctgataacccatctgggcacagaactgcttaaactggagagcaattaaccttcacccgacaagctctgtccaaccgttataaacattaaagagacagaatccttcccccctccttgtagactaaacaaccagatttgaaattccacgtaaacggcctctttctgcagatgtgcaccaacaacaacgtttagggggaaaaggtgggcaatggctctgttcataactctggtaacttttggccttggtgtgagtgggctgaggttattagcgtaaaaattaactggaggtatttccaataaaatcaccaggtttaggggactggacatagttgctttcatgcagaaacccatgtgtcctataggaacacaacttgatgcttgagagattcttttttcttttctttctttcctttttttttttttttttttttttgagacagagtctcactctgtcgcccaggctggattgcactggtgcgctcatggctcactgcaaccttgacctccccaggctcaggtaatcctcctacctccacctcccaagtagctgggaccgcaggcgaaggccaccatgccccactaatttttctgttttttgtagagacaaggtttcaccatgttggctaggttggtctcgctcaagcgatccacccaccttggcctcccaaaatgttgggatgacaggcgtgagtcactgcgcctggacttcttttttcaacagtagaaatatttgcactgggctagactctcactcactcccaattcctctcttccgacatttgcatgagtgatgctgcttgtggtcacagaagggagattttttttttaatctccgagaagttattggttttcatggggagcaaacctgtgatcttgcctttatcagcatttgccgtaaccagtcgagttaaccaagttgggccatgtgaaataccgagtggttagagaatctaccaggaaacctactgttaaaaataactttcacaacactgaagagaaatagctgaggtcacttaatttatcactcaggcatgagctttctttagcatcagttcatgctgagccattggcttgtttatggacatgatactaacaataaataggtaaagggtaagggccctatgacatagagctggctacaaaccaatgtggggtacacaatatgcctagcatttaaacaagaaaaaaatgtaaagtacatgcagaaagtcatatgagggaaccaaacctctatgttactgacctgttaatgtgactgcaactcagatttttttaaatagaaagaaaaaaggaaaacatatatttagcatgtcctaaacaaatttatctccccaaggttttagtgcaatcttcatgatgacctgagatagctatcaaaatagtccatcctaacattcgatcttatctctcccttgaacccagtttctctttttccagtaggtaagtcataatactccaggcctcagagacgtgtttgcacacaacgaggctgagcctatctcacttataaggatgacatatctcactcatgctggactccagaccggccccaataacagttttggagagtggcatggtagaggatgtgtgttacatgggaagtactactgtaccctgggacaagatatcctggcaacaggtcttgttttcatggtttgcatttacatgcttaactgttccttttcctgcctttgtaagactaagaaaatccttactgtacagagaaggaactgtgaaaatagagcaagtgggactgactctcacattgcagggatatgcaccatctccatttttgcagccaaattagatgcaagcccaggattccactggcctggttctcccaggaacactgggagtttcttggtgtcttagcttgaggtgaggtgaagatgggctatgggcacgtgagctgaccagtttttcatcctgtgtgcattggacgtagacaagggcacacacagacatgacaagaatccatgacctagctcctaatgtaaatcttctttcccaagacaatcttgcagagccctcatggtcagtgataagaggaacttcaatttttatttggaatctgacccatttcataagaatgagtaacacctgaatatttaggtgcagatatcaaagacagaagacaaaaagaaatcatagtgtttgacaataatattagtataggatgccgttttatgagttcagtcttaggactgtgtaggtgcaacgtgaagactttcctgaagacagccacatgaatcatttttcataggatgtaatcaccactgtcatccattagtccaggcttgacacatagaatgggggtgactggctgcctaagtaacaaactccccacgtgtgcttctgacgaactgtgtgggctgccctaagcttttgcatgtctcgacacttaccaagtaaaatgatgagataaggaaaaccacaacatcatactcagtatcttgtgaaactgaaatggttgcagagtaaacactttgccttacagtgattttattttgactattatgctggatttaacaatataatggttaatatccatgctataaagttttattttttcatcaacaaaactaattgcattggcactttcaaaatgttgtttgcacataaatgatttatacttaagtatgagtgtaacaatcttgccatcaggacctggtctgttgggagatatcagtgaatggagcctggctcttccaatgggcaaccgttgtttgttggtgaagctgccacccttgagacctgcctggtctccttcccacctgtagctggctaagtagtgtctccccacaattcacgtccacctggaacctcagaatatgaccttatttagaagtaggatctttgcagatgtaattaatgattaaaatgagatcatagattagggtaggttctaaatccagtgagagcatcctcataagaggctgagcaggacacacagaaacataaagaagaaggtcgtgggatgacaaaagcagagacggaagggatgcatctacagcagtctccccttatccacgggggacacactacaagacccccaggggatgtctgaaacctcagacaggactgaacccaactgccattaactggaacactttctgttccatccacaaatgcaataccttttccatcttaactaagcacttactatccactgtggtcatcagttttgcagtttgaggtgcaacggcaaaacaagcacagatttctttttatttcttcaaacttcaaagacagaagattcattcttactgtacatcttagcaaccacagcatatgatctttttccttgtaagtacagaactttcaccttttcactgaaagaaagcactttacggcttctctttaacatacccggaattgccaggatcagtcctcttgtgccttggggctactactgaataaaagaagggctacctacacataagcactgtgataccgtgacagtcgatcccataaccaagagggctactcggtgactaacaggcaggtagcatctgtagcatggatacggtggacaaaaggggaattcatgtcctgggtggagcagggcaggatggtacaagacttcatcatgctacttagcatggtgaacaatttaagacgtatgattcatttatttctagaaatggccatctaatatcttcagacagcagatgaaactgccagaaaccatggaaagtggaatcgcggataagagaggactactgtccaagccaaggaacacagggcttgcaggcaacccccggagctggaggaggcaccagatgcatccttcctcacagcctccagaagggaccaacccagccaacacctcgattttggatttctggactcccaagctataacagaataaatttctcttgctttaagccactaggttgtaataatttgtcacagctatcctgagaaactggtaacagtacttgtggatgctgtttttaacaaaaattttgccactttagggcactatatggcctttttttttttttttttttttttgccttatagagttaggtcaatttccaaaagtgctggagtttatgccaagaattaagtgactccctggttgcagtggccaaatagcctgaaattttcaaagtaatactaattttgcaaaacttttcatgtaaactcctttgcctgaccatgccctaatttttgtgattaggaaaatctggctcttatcccactggaggaaaagtgtctagttcatattctaatggaaatcatcacttgggaggtgttttgacaaacatctctcagttttgtttaaaaattatgttagaaattaagaaaaataacgaatggaaaacaaaatctaatttttggtatattttcctgctaacatttgtgggcaaattagttaaattatgattgtttcatgcatacttactcctccaacagcatcctagctctcttaggagttccttttaattatcctaaaaacagttaagagtatactgagccaaaatataattaggttgagaaacaatgaactcctaaatgaccaatcaagttttttccaacattttaattctcaaataaaggtcatttccttttatttgactccttaaaaactagattatagttcttctaggagaggaaccaagtcagatttcttttaatcacatacattgccaaatgcatgctttactcagggaaagatttcaatatgcatcatttattcatgcattcattcattcaggaaacagagtagcactttacatgcggacgctgtggaaacaatggtgatatgaattcttaaatgattaaagaaacagtccactaaaaatcttatcaagataatagaatacttcagattttatgaaagattacattttcattggcctatatataatgttttaaccagtaaggctcactaagttaaataatatgctggataatcttaaatttacagaagggttttcagttttactatttggcttagataagctggtagttacttgctaaaattaatctttattataaagcagatcatcttgaaactgaatacaaaaacaaacgtagctattattgaaaatgttatgctatctcatatccattagagatgttatttatataataagtactgtgttgtaatttgcctgattccaatgaatacagaaaccctcagtgtgaatcaatatactagacaccagcagacatatttaaaagattgctacagtttcactgacatttcaaagaggtgactgtagtaacaaaagaagaaaaatgaatagtccctatcatagcacattaatacaacttgtcactagttcatgtccagaaagacttattatataatagattgtcaaagttgaatatttcaatgacccaatgcaaatcctggataaatgctggtaggtgttgctgctcaataaaaatgaaagtggtgtttggttttgctcatcaaggcaagtgtcatgtagcaaaatgcaggctatgggttgcctggaaactgtattcctgcttttaatttacaagtgaaacattcccatccatggcctggaagggaccatcatgtactcggcagcactcattagattctgggcagcccccggtcatctgaccttcccaaacatagggaaaggacgtggatagacattttcccaaaaagacataataatgaacaatgggtatacgacaaggtgcccaatatcactaatcatcaggaaaatgcaaatcaaagacacaatgaggtatcacctcacgcctgttcagatggctatggtcaaaaagacaagaaatagtaagtgttggcgagaatgtgagaaaagggaatccttgcagactgttggtgggaacatggaatgttgcagacactgtggaaaaaagtatggaggttcctaaagaaattaaaaatagacctaccatatgacccagcaatcccttttctgggtactttcccaaagaaatgtaatcactatctcgtaaagatacccgcagtgccatattcattgcagcattactcacaatagccaagatatgaaaggaaccaaagtgtccatcaatggatgaatacataaaataaattgtggtggatatatacaacggaatatcatttagccttttttttttttgagatggaatctcagtctgttgcccaggctggagtgcagtggcatgatctcgactgactgcaacctctgcctcccaggttcaagtgattctcctgtcttagcctcccacatagctaggattacaggcacccacgaccacaccccactaattattaaatttttagtagagacgggctttcaccatgttggccaggctggtctcgaactcctggcctcaagtgatccacctaccgtggcctcacaaagtgttgggattacaagcgtagccaccatgcccggcccatttagctttcaaaaagagattctgccaattgccacattatggatgaatctggaggacgttatgctaagtgaaataagccacacacagaaagacaaatactgcatgatctcacttatatgtaaaatctataacaaacaaacaaacaaagactcaatggggaaatggggagatgtaggtcaaagaatataaagtagcaaatatgcagggtgaacaagtctagagatctaacgtacaccataagggatatgcttaataataccgtgctgtgctgtacttgggatttttgctttaagagtagattttaggtgctcttgccccacaaaaaaagaatgtgtaaccatgtaagatgatggatatgttaatttgccttcactatcagaaccttatcaccatcttcatgtatatcaaaacatcatgttgtacaccttaaatatataaaataaaacttttaaaaaataaatcaaaaagtcatagttcaaaccactcttttggaaaagtatggatttgttaatataagtggtatataacaattgtatatgcatctggggaaaatggactccatctttcatgatataaaaagcaattctcggccaggcatggtggctcacgcctataatcccagcactttgggaggctgaggcaggtggatcacgaggtcaggagattgagaccatcctggctaacacggtgaaaccccgtctctactaaaaatacaaacaaacaaacaaacaaaaaatagccgggcatggtggcacacgtctgtagtcccagctactcgggaggctgaggcaggggaatctcttgaaccccgggagagggtggaggttgcagtgagccaagattgcaccacagcattccagcctgggcgacagagtgagactctgtctcaaaaaaataaaaaatttttaaaaaacagcaattctttgtgattttaatatagggtgccagccacatcactgattcatgcactcactcatgcatttgtcatgcaggaagttatttattcatttatgaaatggacatttactgatagcctgctttttaataggcaccatcagcatgactgaaaggttacatgacaacagccacagaacttaaggcatagaactttaacaacacacgttttgagttactggtcttgacgcctggctaattttttgtattttagtagagatggggtttcactgtgttgcccaggctggtcgtgaactcctgagctcagacaatccacccgcctcaacctcccaaagtgctgcaattacatgtgtgagccaccgcgcccggtcggggttctatagattcttaatcatgattaaccagcaatatgataattcaatagatccctgctcacctcccctaaagaatgtgccactctaagtagttggttcaaaatagcttgactttttaacctctagatccactccagagaacagtggtctctccccattgcacaaacacattcatttatttaacagcatcacccaaagcataagaatgggaggaaacaatgaacgtccttcatttctccaactttaaattatcaaaactactgattttctgggctcacaaaaatgcagttgagttcagctgttgaaagtttggttaacatgtcagttgagccaccaaatggaataacagttgtaactctcttatgttttctctactgtcctcaaaggaatagcatgagaacaaagcaattagcatacattcaggagttgcataatgatgttttggacaatgacagactgcagataggacgagggtaccataagattataatggagctgaaaaatctctatggcctagtgacatacagctgtagtaacactgtagcacaatgcatttctcacatgtttttggtggtgctggtgtacaaacctactgtgttgccagttgtataaagtatagcacatacaattctgtacagtacataatagttgataatgataatagttgactatgttattggtttacatatttactataccatacttttcatcattattttagagtgtactttttctatttccaaaaaaaaaaaaagttaattgtaaaacagcctcaggcaggtccttcaagaaggattccaaaataaggcactgttatcgtaggagatgacagctccacacagattattgtccctgcagaccttccagtggcacagggacaagatgtagagatgaaaaacagtgatattgatgatcctgaccctgtgtagacctacgctaatgtatgtgtttgtgtcttagtttttaataaaaagtttagaaagttaaaaaaaaaatagaacaaagcttattgagtaaggatataaagaatgaaaatatttctgtacaactgaaccacatatttgtgtttcaagctaagtgagtacaaaagagtcaaaaagtttaaaaaattaataagtaaaaaaagttatagtaatctaatatgaatttactattgaagaaatgttttaataaatttagtgtaaatatacagtctttttttttttttttttgagatggagtctcgctgtgtcaccagactagagtgctgtggcgcaatctcagctcactgcaacctccaactccctggttcaagggattctcctccctccgcctcccaagtagctgggattacaggcatgcgccaccatgcccggctaatttttgtatttttagtagagatggggtttcactatgttggccaggatggtctcgatctcctgacctcgtgatccgcccacctcggcctcccaaagtgctgggattacaggcatgagccaccgcgcctggccaatatacagtgtttataagtctacagtagtagatagtgatgtcctaggctttcacattcactaaccactcactgattcacccagatccacagccactttccatcctgcaagctccattcatggtaagtgccttatacaggtgtacaggtgtatcatttttttcccttcttaataataataattattattattttgagatggggtctcgctctgtagcccaggctggagtgcagaggcatgatctcagctcacagcaacctttgcctcccaggttcaagcaattctcctgcctcagcctcctgagtagctgggactacaggtgcgtgccaccatgcctggctaattttttatatttttagtagagacgggatttcactgtgttagccaggatggtctccatctcctgacctcgtgatctgcccgcctcagcctcccaaagtgctgggattacaggtgtgagccaccgcacctggcctctactgcattattactatacctttcccacattttgatacataaaaaccattgtgttaagtgtcacaattgcctacagtattcagcctggtcacatgctgcacaggtttgtagcctaggagcacaggctacacttatagcctgtagcctacgtgtgcagccggctatgccatgtacatttgtgtaagtgctctttgtgatgtttgcacgatgaaatcatctaacaactcatttctcagaactgaccgggcatggtgatgcatgactgtgtagggaaatactttcacccctttagaagaagctataaataaccaggtataaatgcaggattcctttccaaagacaaatactggaaacaaacacaatcaaggaagataattgattacttcaaaaaaacaattgagatatgagagtaaattaaataagaagactgtgactaggataagtaaccaataacagcccataacagctaacattattattattgttgttattattatgagatgaggtattttgccaggttgcccaggctgacctcagatactgaggctcaagagatcctttgctttggcttcccgagaagctgaaactacaggcagctgccagcatgcctggtctgcaatttacatcttttgtacactacagcacgttactgttcaaagcacatacaagtattaagctgcttaatccttgcaacactaccaagaagtaggagttattatcatgactgactctcttctacagatgaggaaacgaggcacagggaagtgaaaggcgtggtgggacagggacctgcggtctggatctgcttcatatagagaaactgggttcttaagaaggaaaatgggccttaatttctaaatcgtaacaagttcagccctcactcctcttttttttttttttttcactatcctggaaaaaaaaaagaagtggatagaaaggtactaataacaatgagtttaatttctcaaattttattattctttaaaaaggatacattggtacaggagtaaagacaaaaaaaatcaaaaaagaatcgagtattcaaagacccttgatggtgtaacatcaattattttaattttgtttttaaaatttttattttctaaactcctataataattgtttttcaaatggggaaaaagaacgaagtttttattactgcctttctttctacaatatattattcaatggagatactgaacctgtatttgctacaggctaaagaaaataaaataaaacaatccctagccaggcaagggagattttcagagaggatgccaacagggtcctatcccatcaggcatccatgacaaatctgtctgctgtctggtcctgtagcatcacccaaatgtggttcaggcagcactggaaacaatacagactcaggagatcagggaagtcattttgcaaagaagcagaagtgtcaggaggtagcacctgtaaggatgaatgctggagctgtctcatggagtttcacagaaaggtaacaagctgcacaatgactgtctaggggcaacagatacataggaggaaagcagtcttcattcaaacaggatactgagattgacatagtgtgtcttccaacaagataagcaaaagtatgtgaagaaatgagtccctaaaggaaaatatctctttgggcaatttcacttcaattcaatttcatgttaaatacaaaatacatatattgaatatgtggataaaatcactagaatatattcgtgcaataacatctacgtgagacatgacagcatctcaccatgtctggcagtctctcggggtcaaatgcaatctctgccccccacctggcagtcatcggcacttatggaataggccaggcagaaggctctgttagatactgccttcttcccttcgcaatgcactgtcccagacttcctggggtgagagaagtgattgtctatgagagctagcttggagtgaatgaaaacagcatttaagaggctcagcattttctgatcgccaaagggggtacccttcaacatgaggtgacccagcaatgattggctgctgagttctttgagtattttagggacctgcaggagatctgggtggagctgtgggtttccgtgtgtacagtgtgtaaacatcaccctttggtgcttcgccagtgcttaaggggctcccaggtgctatttattttgtttagtttattgttcagtgttattgtttgttgacttgatctatttttttttctcctacaaaggggccagtctgcaaggacacatcctgtagatggctaattgatgatgccctattgtttagtgtgtgtgcactgtggttttatttgcttcggttcaaagggcctaaacaatgcattcgttggaatttagtaactgctgtaaaatcagcacagagaacaatctgtgagctgatattttttgtacccaaatctggtaatctctgcttgactaaagaaagcaaaatctaaaatgacctttcaactaaccatagaaaaggccttccattgaatctcaaagagacttatttttctaccaaatataaaaacattcgaattatgcatcattttccatgattcaaaggagacagaggtgcctacggggcatgttactcatagacaagtctattctagtctaatcacgtccccttaaaaatcaccgagtagatgacaccgaggatgagaacgaggtactgtaatcattactttagaaactttatatttttacctgtttcaagacagaattctcctagaaaatctggagcaacaagcttattccccttggagaggagataacgaataatggaccacgcattcggagagaggaagtttccactgggagcccttcctgcatcagtgcgtctctggttgggctggctatctgtgtaggaagtgaacgcaggaagtatctgtctacaaaccctttatcctcaaggtaattgctgtagcagcattttactgtttaccaaagcagtaaacatgtgatctaaaaaaagatgttttccatctccagaagaacaaggctttaaaaaatgtatacatgtgcttattttgtaaccagcttatcaaaattggttacaataggcttgggctttcaacagtgagtccatgaaaacagctcttgggatggacagaggtaccctcacagggatgcacaagaaacaaagaagtggcttccttcactagaatgctatcctagcaacacacattttatgtcttttctcctaagaccggcttaaccgagttcatactgtttggcttacaaagaaggtaaagtcaacaaaactatctatgttaattcaggttggtagaatgagtaattcacaaagtccaataactcataaaagtcacttacatttggccttggacaatattcttatttttacgtgactataaatatgcttccagtttaggagttcacacaagacaaagtgaaaagttagaactcaaaaggagatgtgtagtggctgcttttgctgacttttgcctggcgtaggccaagcctcctggtccgtcttttcctttgtttctttattccagatcaagcttgcaaacctgcaccgtcccagatttcctggggtaagagaagtgattgtctaggagaggcagcttggaatgaataaaaacaggtccaggaaggatccctcagcatttaagaggctcaggaggggtccccctcatcatccttgttgtcttttgtgtttttcaagccgccttccaggtggatagcgattgcaatgagagagaaagagtatggaaggagaataagaagaatagggagacacagaagttaacaacgccctgaatgtctccttccaggacctgctgtgcagtgtccggtgaactcaccagcaagcatttcccagccctgttttaagcaatctccaatgcagatcaggtgctcgtgaataattgggagctcactgtgtctgtcagagttcttactttataatgaagagataaaaacatgttcatcacaggaaaatggacaaattggctaattgaaaacaaaattcaattcacaaactgttgtagaaattgaaaaaaaaaaggtagggggaaatgcttttcatagattccctgattttagtcttagaagaaaaatgtatttggcttgaatgaatagtaaaattaactaactttgattgaggagcttatgtgtgccatatacagttctgggctcttgcgacttggtgaatctcactataaccctgtgaagtaggaactatcactctacccatttcaccgatggaaaagcctatctcctgtgaggctgtggcttgccaaaggtgaaatggccaggaagtagaacagccagggagtgaaccccaaaagccaggtgggagcccatttcccctgcccactgcacgagacccctccccggtttgaagatccgataggggcactgctgttagctccccctgcgtcctggcagcagcacagtcagcagatggtcactgtggagaaggcggagctgaccacctccattttcctataagggagctagggccaggagaggtgcgttcacctggggaagtcctgcagcatcaaactaaagctccgggccaccctctcccagatgggcctctttccacttccccttgccagcagctatatctatgcctcccatccgttgcacggaagataaggccaatcccttttccacagaggctattttaaggatgccacgaagaaatacagagtaccaagtgcctccctgggccaaagataaaagtgggctgtgctctctggattcaaccttcatgtttttgatgctctctggaaggtcagggaaggcacacatatcgtatggatccaaagaggactacgcaatgcaaaaccacatactttttttttctttttaacttggagcaatgtcttgggacatctacctcaaattgagacacaaactaattgtgttgacagattctaaagtgttgtttcaacagtttcttcttcctcaaaggtgagcatcatgtgcacactgtcaaaattaaaaaaaaaaaaaaaaagacccaataaaacccgatgaaacccaaagagcatggagatgagaaactcactgctggctgacgatctgaatgaatggccttggggggaatgtgaatgtggaggtagcagaagggtcctgtcttcagtgcttgattctgtatcaatacttggtaaatttaaaaaacaaaaaaaccagcaagggagattttaaatcatcaaggcagaaggatttaaaaagtggaatgtgttaaatgcaagagtgcgggatctttgcataaagttattatattttcaaaaattcgacaagcattgtttttaccaaacgtgtttaaagtaacagccctgaggttaatgttatgattggattctgatgtggcactttaaaaataaatcattttgcttggccttagcatttcttttcaaaatgtctctgtacttatctgtgtacaacagcagattaccgttcttcccagagtttaattccatgaacaccctgctgaaagacttgttaaggccttatggaaaactctgacctgcgtgttcattattgacgcccaagacgagtgcaaggaagttgatacttgggatgaggaaatttaaatcagcagctgatctggaatctggaagcactgccccttggatctcgccaaatatggaaagaattcttgtcactgagcaaatatagaattcagtgctagagttttacctcttgaattttctagaactttgttttgattagccacctagagtataagaattgctgcctatgggatttttcccagaagagtagataacataaagtaaccagcgataataattttcattatccaattatttcatgtgtctccataacacttaatacatcatgtttctctgcacagtaattcactatgtacagctagggtgaatagcaggaaaaaagagatcagatgataaagagaagggagacagatttgtgtgacttgtataagatacttcgcctctctaatcctttgtccttatctgtaagaaagcagcagtacccaggctgctgtgaggatcacatgagacattatgagagtttagcacaggacttggcacataacaagcagttattaggatgatgttagtttggattatgaattcaagatactacagctacattttttatactttcttaaacatcaatttaagtcaattttaattaacgttattttactaggagaaatgtctctaaaaacataagaattctatttgaagtctacaatgataattacattactctgatatcttaacttcctctttatgatttcaaataattaaaatttaagtttatgttttcaacaagtgcttattgaacctctactctttgccagtcactgttgaggacacagaagaaatggataagatatcactaaaaacagcttctgcgatatcagtgggtatacataaattattcacactcaacaacaaacacaagcaaagctgggagaatgtgctgacaggaaagaaaatgaagagtgggagagtggacagatgggaatcgatgtgaaattttataaaacatgtcttggccaagctcagtaggggaaatatgtggaaagtaagctagaccaaacagagaataaaagtataaataagaaaaaaaatccagaggtcacagtggaccactagccaaaatgggttcacagcaaacaaacaaaaaaatgtaatgaaatactaaaattaaagaagtacaaataaaaatgagattctgttcttatctgtcagaatggcaaagattcaaagagtaaaatattcagagttgttatgggtgtagtgtggaactggtctcatatgtggctagaaaaagggagaactggtataatccttccagagaataatctggtaattattttttaaattggcaaatatttaaatttggcaaagacttaaaaaatatatatacccattggctcaataattcctttctaggcaccaatactaataaaaagtattcaaaaaattaaatagatggtgtactgcaatataatgagtgaaacatcgcaagcagcatcactttatacactaggatattggttataaaatggtaatacatattttagatagaatataatgaaacaaaaattttgcttatcaaaaaatgttagtaacatgggaaaatgcttgtaaaacaatgctaactgagaagagcaggacaggtaggtagatacaaggccaaacagatacacacggtggagagacatatcccaattgttaggaatttgctgtggttggttaggatctgaacaatttatattgactttgtgatgacttttaaacgttttctctaccataagaattttttatgtttataatttatgctaaagaacaagatgtattttttgtaattcaggagtaaagaggagagtggggtattccagggtgctgttcctgccctaaccaggagcacgatgcagtcataggcctctgccctcctccagcagcctcggctcagaacaggacgaagccaaccctctctgaccagcaccacctcgggcgacccctggacgctccacctgcccctgtgtgtggtacctgccctgctacacctttaacaagcacccctgcaagctccctcctccttccttccctgtcctgtggctgcccagacccagatgtaccctgcctgggtgtgggaggccgcacatcagagcagtctatggctgtgggcttcacagctgaagctgggccgtgggaaatgttgagacgagtgagtgcagagcctgaaagacaatacggtagaaaaggttacatccgcgggggggcgtctgatggcatctgccatttattgaggatgggtgcgagacagggtagccattatgatcccattttacaggtgacgaaactgagatcagacaggctagctaccttgcccagggtcacaacaggaaggaagcaaatgcaagtgtgtctgcggccacgtaaggtgagagaagcgctatcaggggtggtctgacagaatccccaggccagggagcagttgtcctctatcctgtggggtcaaaggaggggacaagaaggctctccttgaggtagctccaaagaaaagaccccgccagagcacagtgtgctaccaaacgctggaacagcctggagactgtccctgtctcttctctgaggtttctcatttcagagaaactctcatccgtctggcttccccatggcccttactctgtgattctcttatgtatcagctgttaaaccaataaatccgccaaattgttgggatgcctataatggctttgggtctccactcccacagagggaatcttattctaaagttctaaatgtatcagtcatattttcctgaagacaacagaaatggttgtttcatttacttatttttatgtatgctttttcaagagttgttaacctgtgtttgtgtttaaataaagatctgttttgcaaaacaaaaactttatgagataatcacttataaacgtagataattaagaaatggttcaggctcagcacattgtctgagagcattgcagtcctgcactgtatttcatgggggaagaaaagcccacagatggagccattctcaatcctgctttccagggtcactgagtcagggtgcctggcatgcatgggtgcatgcacacacaggcagagggccagggagaactgtgctgtgtccacagagggcagcctggatcacagagctgaccaagaacggaagcagcaagttgttttaaagtagttgcctgtaaagccacttttcggcaaggacaaacactcagagcatgctctgaaatgacttatgcacagcagggcagcggcattttgcccctggccttccttccattctcccggaatccccctaaagtaacaaggactgacgcaattcgtatttcacttagccaacaggttgatgaaaaatcataaatctgtagctattaaactcattaatcacatccatcaaaattctgtgaggagttaactttcttcatataactcttagtcttaattaagtttccctcacatgtgatagcaaacgttcaagaagtgcaaatgtgcagacgtggcgtatataatgcaagctttatgtctttaaattaataaaattgagtcctatcaggtcgtgtttcaattaccatcaaaccttccaacctctgttaattcaaaaaaaagtaacttctttaggcaagtcatggaaatagcactagggtgccctcaggtctccaccaagccttgttagtaactttccatgtcctgtctgatttttaagatgctttcccctgatgctgctgccggctgctggctctctccacatccttcaatgtcagatctctgtgatgatggaaaatcccccacattccctttttacacattaagtatctttctaggatcagaacttgcaacctggggttcatgttctccttaaaaggtccggggagaggactgtatttctgttgtaattctatgtatttctttttaggcaccagaaagtattattctgagaaaggactgtaggcttcactagacttcccaaattgcagatggcattaaaaaaaaaggaatcaggaaagtctttgggaaattaggctaaaactcctaactgaagcacaatcgagttttcagtgcaacagcaggatccctgcagtctgtagcaaacactgagatgtttgtggggacagtggggccggtgaggttcagcacctctcaatattgtcagatgtcaccaatgcccaagggaagcaccaaaaccaatcagtgaattgtctgcaaaccatcagctttgttgcttccaagtctttactagaactcttaagctgatcttaaaattcacagacacttagagataaatgaacactctcacataagttcccaaaattcctttacttcttccaattgaaacattttgttcccaatttcaagttaccaagggaaaatgatggtaagaatcacaaagactggatacgaatatttagcttttcatagtgtctcatagggtcttacaaatgttaatgcaaaaaaataaaaactccactcaaatgcagaaaaccaacttaaaaaattcagagcatctgatacctaatcgactaattgatttatttactgaaacaacaaaaaaacagagtgcattgagactggaaattgcctctatggggggctgtttcctaattccagtggacagccatcattttccctatgctaacttgggctttgcgctaacgtaattgaaactgtagtcaacagactcaggacctcctttttccactctataaacaaggctgtaaaatcatctcattactttacccaggaaatctaacagaaacatgtcttaaaggaagtcacctataaagagggcctattttaacagaagattaaaaaaaaattcacctgtagtcattctaagggttcacttgggtacatacaataaacacataatgcaatgtaataaaatgttaaatcaagcatagtaccttagacaagtgtaaactattatttccaaaaaagtgttcagaaaatcacaaaatattcaaactttcaaaatagcttcatgtattcataaatgtatacttcaaattaaacagtataacacatttggatgttttgcaaaatgtacctaccttctaaaggatggtctgttatttcaatgtcctttttaatgcactgagttttttgggaaaaaaaaccacataagatcgtacccaagctattcaagatttacacagaatatttgatttaacatgcatatgaataaggatgaaaataagaacaaaaaaataacattttgggtcacaaaatcaagtaatttctattcatgtagctataagtagggcacattaactctcaattttataattcctgtctataggagccatatttcagcagattccaatccttgaagccaaagaaagaaaagtataaggtgaaagttcttggtacacagatttttaatatattattgaacacaccttgagaaataaaagctgaacttctcaaacacagtttctatggtacatatgagtcaaatcttctaatacaaacatttcaaattatgaaaataccaaaccaaagagtatttttgaaaatggcttggcccaattctgggcaaacttccattttcttatgcactttccaacaaactaaaagccttatgaaaacaccaccaaatgcttctcacctccgtgcagcaaaactaaagacatgcaacaaacacaattttcttttccctccactcagcatctgcttttgttgctgatttttcacatttctacaaatgtcacgaaggcatggtggcctttaaaacaactgaacggacccccattcaagactgcatgccccttgacttgtagtcaccattaaattggcttcatttccaggaatcaggccatatttaggattgtacctgtgcagatttacctccacattaatctctacatgctatctactaaaaacttaggcaaggaaatgcatcagaccaaacaccccacagcacagagaaccgaccggccattgctttccaatctccgcaaacctaaccattgctggaagaaatcttactcacagtgcacagacagtaggtattttattgaagataaacatatagtggaacaaaccaaattacccccatttgagttacgtgagcactcagttctcagcgtggatgtcccacaaatcaagtcaacatttgcgtcccattaccagcagccacttgccgagtatctcttcgcttccactgggactgcctggcatccctgatgctaaggagccactgaagagcctccaaatgtctgacattcacaaacgcatcttttgctttgacccgacccttcaacctctccgagtctgctgccttttctcagacacacatccaggcaccgttagggatagttagagaatctgaaaattcagaagcgctccgaaaagcctttccaaaagtaatccacagcactcaacagtgaatttagaaaccccaatttttttctgagtttgaagtttttaagccttgcggatggttggagtaggaaaaaggaaatttactaggcagtgcaaaggaaatcttgttgtcctctattgtggcagtgggggtgttgcccaaccctaacttatctgccttgataaaggaaaccaaagaaaagagtaacaagaacaagattttgtcaaattaaaaggaaccctttccttaccttaatagtgctggccataatgcgatcaagtttattgatcgttaataaatgttaataataattattgcttctctctgaccagaaagtagttttgatgaggttgtttagagcggatgagattgtgctaagtctgggaaatgaagtcagccaatggcaggaagaggtttctattggtcctggctgtccagcccaaagaaacaggatatttgggagtggagagataagagaccctgaaaacaatgttgtttttcttgatgatatgcagccaggagattttttttttttaattaaaaaaagaaaaggcatcaattgggatggggactgccacagcaggtgtgaccggtgtgccgccgtgtgacacactgcactgagaccaaggcaggatgcagatgtgatgggactccgcatggcttcacacgggctgcaagcaccttggagccaaggcgttgagggcaccccactgccctgggtgtcagcccttcgcagcccaattcttcgcagaattactaggacagaggacttgagctcctttctcctaaaaggaaactttgcaggtggagtttatttcatgttaatagatggccatgttcagtaacagccattgcctggctgatttttaacaacctatatttattcaacatttcatataagtgttccagaacagtttcattttctccttccaaatacctgcactttttatttgctctacaacaaagttgttgaaaacgcaaggactctaggcttacagtaaacacaaaaaataaagaggaaaaataaaccttcctaagtcttgttttcaagtatttattaaaacccaaataactgaagtgactacaaatgtcccggaatatcagtgagctggtctcactctgacagacatccatgttgcagacaacagatcctcatagaacttttggctacccagagatgccatgtgagggccccattacatgtctaaaatccaagctataagttcagggtcacaggtctgttttctcctcgaaggaagtacagcgaatgcaggcctgaacattccttagagggtttcaggactttaattactcattttcaggaaattgcttggaagaaacattttgctttgaatctagctacaggaacgcaggacccataaagaggtgtggtctcaataggcgaccccaagaacacaatagactaaatcctgagtcatctgacaattcctggttgcagagctggacgttcagtaaatggatttcactcagactttaggccggcatgtgtcagagttctgtccaccagcccaggtcattctggcttttattatatacctctgatttatcacctcatgttaggacaaaagaaggaggagaaggagaaagataaggggggaaagggagaggaaggagaggaggaggaggagggagggaagagggcgagaaaaaatggagaaggagaaaggaaggacagaagagagagagaaaggaaggaggatgggaggaaggagggaggaaggaaggagaaagggagggagggagggaaagaaagaaggaaaagaaaagaaagagagtatattgtaagaaaatcattctgtggaaatcagaacctaagttctcagcacctacattatgagggggtgttgatttccgctcttttcatctctgaacaatgaataagatggcaggctgattaaaattctgtttccccgaaaatttcaaagtcctgagctgttttatctgggcagcttccactagaattctggagtgcggaggagaaaagctctctcagcttccctgagtgtccttgctttttgttctctcctaagaagcatcaatgtaaaatgttaactgtggcctccacaacacatggcacctgattatgcctttaccaaacaccagctttaaataagatgaacgctttgctaatgaaatagccacggaagaaaatcctgtgtggtcccgcctcacccacgcctcgtggttgctaatccagccctcagttgttccctgcagcaggaaagatcagcatttctactgggacctaatgcttcagtgatgatttggccttaactccctggttcttgcctaatgcaaatcaaactgtgaagagtgggatttcttacctctctattttgaaataatttccaacttacagaaaagccacaagataatacaccaaactcctaataccctttgcctggttaactctgattgtctactggtgccaatgtacatcattttctctgctttctctcacacatgctctctctctctcaatctctgtctctctctcccatatttatttatgtataacatacatgcatgcatatatccatcattttctaactaataaaaatattgttttataagagacaaatttatttattggatactaaaaaagagaaaaacagatgctattatttgatcaatattcgatccataagttttactgcgtctaattttggaaatgcatacaaacataaaaagtgatctaataaaaagttaatttggggatactgagtggtaaattctgttccaaaattttacaaaggaaactcctcctcatttctaatgacaaaatgtttgattgattcctgttgtcttcaaagagaataattcttgatgtttcaaatggcatcatagcatccaagcctggtaatctctgactatttaatgtaaagtgttttaaaaaaatctttggctcttgataggacaaggcacatcttttttttttttttttttttttttgggacggaatcttgctgtcgcccaggctggagtgcagtggcgcgatctcggctcactgcaagctccgcctcccagcttcacgccattctcctgcctcagcctcccgagtagctgggactgcaggcgcccgccaccacacctggctaattttttttgtatttttagtagagacggggtttcaccatattagccaggatggtctcgatctcctgacttcatgatccacccgcctcagcctcccaaagtgctgggattaaagacgtgaaccaccacgcccggccaaggcacatctattaactagaatatagcagtgcagaaaccgtttcccaaatattatcctatggggaaattatctgaagatatagatatcactctagctttcctcacttgtaccccaagtctatgttattaaatggcctcatccctacaccacccagcagcctaagaaccaggctgcctttcccacctgatacctcctctccctagggaaatatgccctccaagccaccacgcggaccaagttagggggcaatctggcacacggcccctacctgaggcccgtcctgccatgagcctatcagggcagggtcctttttcactctccttgagatgcagtaatcaccacactagaccagcacagcccatacagtagctgtggacagcagaacctatgaataaagcacacatttcccttgcatgcttctctgccacaaacccatcccctgtgaatctgccaaaaccttccactagtctcctcacattttactccaaagaaagaaacaaaataatataacataaatataccataaattcactgtcacaataaaagaaacactagtatttatttatcctaaaatcatttcttcccattttctaaagatcgaacaagttctcattcttgttcccttactaacttctctgtatggaatatggggaggaaggttaggagctaagaacactctgaatgacagccacatggttctcaatgtaatacatgcgcagagcaaagagaggagatccgtctgaacctccacatctgtggggacacaacagaagattcactcatgactcattcacgtctttatccctgccctatacatccctacaatggaacgcccttcctcctcaaaaacattgcaggaaaatgatgtcgtagatgaacacttagcaatatggaaaactgctctgatattttacctggttagttaaaaaatcacagtatataggagaattatatccatagactcattttgttaaaaataaaaaggcagttggggatggccgtgcattctgttccaaagcatctgtgaacctgaggaatagacaccatgagcgaagctaaccttcccgagttgaaaaatgaaatgcaatggtggcagacatgtccaaggaatattatggggactcgatccctttatgaatcttgtcatagatgaatgtgtggagatgtcaactagttggcagcagaacagtattggaacggtggtaatacaaggaaatagtatcatcatattagaaactttggaatgagtataaataatggctgttcaacagaaaaacccatgtcccctctccaaagggcctgtttcactatatgtaaaaattaggtcatgtatgttttcatattagactttttgttaaataaccttttttttttttttttttgagtctcactctgtcgcccaggctggagtgcagtggcgtgatctcagctcactgcaagctccgcctcctgggctcatgccattctcctgcctcagcctcctgagtagctgggactacaggtgcccgccaccaccctggctaattttttgtatttttagtagagacaggttttcaccatgttggccaggatggtctcgatctcttgaccttgtgatccactcgcctcagcctcccaaagtgctgggattacaggcgtgagccaccacgcccggccaataaccttttgtaatagtcaaaaaataaaaaataaataaaaaggcaaagtaaaaatattgacagctatatcttataataccaatggcagagaagctttttgttttttcccctcttcttctttggttcacttatattttcaaaacataaatttgtaataaacataaattatatcctaatataaaaatatgtaagtaacatgcaatgttgttcatttttgtaaatatctgaaaaatacaggcatgttctgtaaaaagtgcagcccacaatacttgtaggtgtcaaaccttttagcatgcccaaatgcctgttcttttttaaatgtctacagcaagcatagagctctttttttttttcattttattaagaaaacccagaaacgctcaagagtttcgtggaggccatctatgcggcattaatccattcaggtgatattaatggccttttcctgccaggaactccagtgggcactcaggaagccaggattacagggctctatccagtcaccgcatgtctcggcattcgggaagcctatctcagtctcctcaaattctgcacacataaaacttcagagcctgggagcgacccatgaaacgcaggtttttaaggacaaaacaataggacaaaagtgctgtatattgtccttaagatgacacatgaatttaaaatgcatagtgtttggattattcatgagagccccgcaagaacgatgtcccaggggtttttgccaggaacatgcctgagattgtagataagaatcaagcatctggggctgccgcacaatggaaaactccagcactccatggaacttttccatctgcagcagtcggaggatttgcctgagaacatacgcggcatgaagacactctcagccctcaagggcacccagtcagcgctgtttaaggacggtttttctgttcacagcatacttcatgattacagcttcactccattggatacaactatgtgagtatgtgtgtatgagtgtgtgagtgtgtgtatgagggtgtgtgtgtgggggggtaggggagtgccatatcccccagcagcacattaagaaataatccaattacaatttaaataaccattgtttcaacactttctctaagtggtgaatgtattcttcagtctcttggttgatctgaactaatagaaaccaaggaaactgttatcacataccaaatcctcaacttctcaacaccaagttgcaatttccttaatactgaagcacacgtcagttcagttctataagctcccatggagcaatgatttcaataaacacaatttcataagcatcccacacgttctcaagtttaggccaattttgctcttactcaactccatatgactttaaaaatgcaggaatattaaaaccattatcaaggactccaaataggtcaatgtattatctgtggttttaagaaagaaacctaagaggagagtaattattttgtcaccattatttagcttaaaataacttttaaatgtattgttccaattattaggcttctccatataatttggaaaccattaaatgagtttcaacttctttgtccgtataactgggtatatctgagcatagatgctacagacatcacgttgccattggtgcccataaggcttcgtatgcccacagggcatataattaagattcacaaaagcatctgactggcatcccactctacccccgactcagatccaaagtatcctttcccaggtactgtcccctgtcaccatccttggccaaattgagaatttatcccaggttgttgaaattaattttgattttgattctagtcagagttttaaatgattttttaagaagtgtgtcaatctcacctataagatactaaacagcatcacttatttttgtcttaatctgtcactattttatgaattatttttaaagaaaatacagattacttcttaaagaaagatcataagtggcactataatagcattcaattgatagaaattgatgtagaagcctgcattaataatttttcctgctgctttctaaagttggcttttagttttcggttgaggtgggctttaattcagcatcacctcatttgatgatttatttactaatttatttccatcacaaatggaatcagaaatgaagcgaaggcaaaaaatctttgccacaaattcatttatatttgcatgagtatcaccaggctacctgcggatgcaatgaagccctatacccgtgcctgaagtcaggagcacaggacactgggagtctgtctcagcgcagtaactgctacatggtacgctccacatggtatcctctccacctgagccctcctcatccctcgccccctctccacacctcaccctctccacactgtattatctcccactgcaagcaacgcagaggacacagaggtgcagctgaagtgaaggcaggccagttcttttccaattcactcttatgaaaatgtgttaaatcccgttaaatgcaccgacctgaactgaaatgatgatatcagtaaatttgttgttgtcatctgatgcccacacagatctcagcacatgttttgggaaaggctgcagtgttcaaggagtactagaaatgttctttctgagtggactggccatgataagccaaagaatattatagccgatagggataaatcatggttttcccactgcgcggttgcctggtggagattattccagcctttatttacagctacaaaaataatcctgcctcaaggattttaggaagcaaccacctcctgcctaaagaactacactgcattgttgacttgccagctagaaaccagacatgagtcgtgcagggaagttccctttgaacggcttgaattgttgtcactagagggtgctaaatgcccctcaaaaaggcctttagagagaatactagtgtgcctaattcttgatttaaattccttgaattgacattattttacaaagtggtctcattttttacttgttaaaattaagatctaacatttataatgcagaaatggtgtttttttttgaaaaatttggattgttcattattatagaacataaagaaatacacgttttaggagcaaacatgaattacacagatctgaatataagattaaaggcataaatctgggggggtgagatttgtccatggaaattgtataattgttttatgccactgttaatgattttaaagcctgaaaaatttaccactttacaataattttagattgttcaatatgttcccaaatgtgagttgcatcaaattcggtaaatgtagagtatgtttgttttctctgtacacaatactgacgtcagtgctagtgcctgcctaaactcagacaccagtagatccttttccagaactaagtgttataggaggaatatggattatactgtaatatatcagatgtgaaaaaagcctcacggtcccttcctttctcaaaaaaaacgtgtagtattttggaatatgcatggagtatagcacttctaaaaatggtactttatgtatatatgaagtaaaataggccttaaaacttaatatacagatttccttgaaaataatcttattatacatttacactgactttttggtcatccaaacattatgcacttaagcaaaaagaaatataaccaattttgcaactttcctcttcctgcctttgcttctacttaaaaatatctgcagtatttccttttctcgccgcttccactttggttcatataccaaggaatcgtgaggtcaatgggtgacagttgtttgtctgtgttcacggctgtcgggcggggctgggtgtgggtaaggctctgaccgacatctgaagaggcttcacccactgcggtttaggatacattttcctctcgctctgccagtagaacagggaggctagttttcaatgtgttctacagaaggataattaaggcagtgtgtcacctgctcgtctgctatttttaaaaggaaacaaacataacctttgcatgtgagaggcattgcaaactagatgggaggaggcccggaccctgtaacagtcgtacattccggtcccagcttcgctggggtgcaactgcagataaaagacgctggctcgacaaaaagcgcccctgggctctgcattgccagcatgcacaatacgaattgctaatgatgagctggcttaggtaggaactgaggaccctgagtgcagggctaacctctgcttcacaggaggggtccactggcgcgcgctggaggcggggagccttcgtgatatttctccgaagggaagagtccatgcagcatcctgataacagggaccttggcttcatccccaactgctcggtgaccccgatgcgtcatttaattcatttgtgccaatattcctttttcaatcaaccagtaactttgcaggtttgttcaaagaagaaattaaaatgcattggagatggaaggcagccatcttcccggagccccagtgctgacactgggaggggaaccccaggattccctcatgactgtgtcagtgatggccctcaacaagcacttactgaatgagtgaatgaatgaatgaatgaatgaatgaagccggccacagagcccaggagtatcaggggagagcaatactggctgtgtcagtggctagtccaggagagcccttcaagagcccagagttcgacttgaacttgggactcccctgggatgggtgaggttctctcaacagcagttgacaggagggaactgggacaggcccagccagtttcattcagtccagccagctgtggctcctctttaggaatgtggccaggcccagctgtggccaaagcaccagccagtccctcagttctgaacagaacgtgcccagcatcagtgccttcatttgtttttaaactgcctgctgaccatccacaaagttaagatgacagctgggacttaagttgtgaggaaccagtggctcccccatcactctctctcacacacacgcacatgcacacacacagagacacacagacacacacacatgcacacacacagagacacacaaacacacatgcacacaaagacagacacatataaacacacatatacacacatgcacacacatatatacacacagacacacaggcaaacacagacacacaatggatggtatcgatatctatgaacagatgagagagagagacagagcaggaggtcatctgctccccacccctcttctccccactgtcaccacctctctcccaagtctagctgcaggccctgtgagctgtggaagtggcttttttaagctgtcttcttagattgagtcattgggcagtgaggaaggtaaattttctctaagaagcctcccaaatctgtatcttatgggatttccgtctcaataattgagctaatagtacctgtaagcaagtggatagtcaataaaaaaaaaataccggctgtaagaacgaatgaatgaatgagtggatgagtggatgagtatacatcctctattttgctggcatcatgattattttacagcagatttatctggatttcaatataaaataagagctcccatttgtatacaacttagtccttgtaattttccaaagtaactctgattaaaattatttccagccaaactatttaggcaactgggttggtttcacacgtacttatcagaaaccattagaatggtatattgattgcatttctagacatttgccataccaccatggcaactgtatttcccaagatggcccagtaggatgtcccatcatgcataaccttctataaagtgacattgactttgcttccatcagaaagtgaggtccacgttcccactccttgaatctgagttgggctgtgactacagcagaagttcagctatgtggcttccaaggctaccttggaaaggtgatagagcttccacctgattttcttgggaacagccactcttaaacctcagccaccatacggggagaaagcccaagccatgtgacgaggccatttgtaggtgttccagtcatcagtcccagcccacagccagcattaacccccagaggtataaatgaagaaaccaagatcactccagccccaaccggcacttgactgcaaacctataagagactccaagcaaataatatctatctcagcccaatcaagccctggaaccatgagagattctaaataataaagtgatcattgtgattttaagccactgagtcctgcagtgagttgttatatagcaaccgggcatcggcataccatcagaagattccttaagaagaaacttttgcaacgttgctacagcagaaaatattccttctgtatgatcattcatccattcatcaatcttgattggcattgcctatgtgctaagcattgtcggtcactggaggtgcagaaaagaagtgaagcagtattcagccaaacaaacaacttgcatattggatagagagaaaaatatgccaaaattacaacagtattttgacccaacagaaaggacataagaagggaacatcaacagttccttcctattcttttccaccctttttctttctaggctcattaaatgtagaggtgcctcagggtcactttgccccatgagagtagataccctcctctcccatccctaactttggtcttcactctatgcctgataccagcagctccccaggctcctccatgctgttggcaccccattcccattctctggaaacatctcagcccatcaacctcagattactttcccaaggagatgtgagaaaacttcaattttcccctttgtgacttgcagagaaataggggtggtaaatgagaagcagagggagagggtggggattcattaccttgagttactaaagagaaaagctctagtgtttagaaggtgctgttattattttctctgaaacattagctcctagaaatcagaggctctgtccctagcatggtctctaaggcttccaggacgccccaggggcttccctcagtcaattttgactctaatgagagccatctggaaggctgcaatggtgggcctggctgatcactggaggggccttcgctgtgggcacagggacgtgcacaggttcacagagtgtgtctccgtttctgggaaccatggtcctgtgtgctccttccccaaagaaagcaggagaaagaaaaaccacagtcctgagtgggattctccccaaacatctaaaaagcttctttaaagaagtcaagttatcataattaaactcacatatggaatgcctatagacaacgtgttgctcttccaatcccagggagctaggacacccaaaactcacctcccagacggagctaggatttgagatactggattccacattacttaaagctgttcgagcttttcatcaggaatggaaagcattaatgcgtctcacacgtcactctctgtttcatggaattcttacactggggagctctttttattttactatttttctttaacagccagaacactgagaagtttgcaaagaaatttttcagctgcctttagtgacccttaactcaagaggttttgcctaatctgtaaattggagttgaaaatatttcagtacttttggagtggggagctttttgtctttaaaagagtggaacgacactaacaatagggctatacataccttgtgcttctttgtcagttactgcaaaccaaaaccagatgtgaagtatcagcggctacctcgtagtgacccatggaagttgaggctaatccatatcattcttaataactcaaaactgccaccttttaaccacctaatttttttctcacttacaaatgcaaaaaaaggaattgacagtacacattgaaatcgattttcccctgaccacttacagattttctcctataagagccaggaataaaagctcactccattatatcaagcagccatcatctgagtatgctttagtttaggtgatcatcacctttaacaaaccaagatctggaaggaagatttctgatctttaacaaaccaagatttgaaaactagatattcctgtcatgaccttttcccaacattcagtatgtaagggattcactggattattagactgcttgtaaatgtaagaaaacatagaaggtttagtgtgaaggagttagcaacctaacaaatgtttccccctgaattttcaataaccttcctgaatttaaaggtaatgaatataaatgaagaacaaaatcaatagatataggaatgattcacaacctcccaaatgaataaatcaatcattccaccctacatttgaacattcaatcaatattttgtctatttactaaatctaagaggaactactttaacataaaactaaatatgaaattatttccagcattgaatattgtgttttgccttagagcaggcacaaagtggaatgcctatgggtacaaagctaggcattgattgatgtttaatacctacaaatacagcaattacactgtcatgctacacgagacttcctattcctacactgaaattagactgcacatatgtagggataaaagataagacacaatcatatcatatttcctcaaatctaagactttgggtggtaagatgtaaagcacatcatgatttaaagtatcactaggaaagaaaaaacaattctgccaatgaaaattcaccgtaatactttctaatcaatcaattttaagatacatcccaatttttaagcaagaataaatgtgttaaaattaacacaaattggtacacttgtgatacaacagaagcactaaaatgtcacagcaatagaccacagggtttctcaaccttggcagcatcaacattttgggttggttaattatctgttgtgggggctgccctgtgcatggcaggatgtttgctagcattcctggcctctacccactagatgccagtaacacctcgcagactccaattatgacaaccaaaactgtctttagacatggccaactgtccctaaaggtgcaaccaaaaactgtcccagttgagaaccactggaacagagcaattcggttttatcagccttgtaatataattgtgtgtgtgcactgtgtgcatgacagactgtcagcctaatggaaggtatattgtcagatgggatagattgacctgaaaaaatcacataaaccaacagctggtacatatacaagagtgtgtcctgcccatcctaacccacacaatgcaaaagaacctggatgaccacgagtcaccatcacaggagtttactatccataagtgtaaaccatccaagaaaagtgaaaacagattaaagaaaataaaaataaataaaccaccacacaatatttgggcctagccagataacaacaatgaaaaaatgtaatattttgaagtattggcaagaatgtggaggaaaaagcattgacattcgtgtataatgggaataaaataatttatcctttgtctccgcaattgatattctagaaatctattttttagaaatactcacaatagacagttataagtacaaaggatgtctgctattacactgctcagtaacagtaaaatatgaaaatacactgtacgtctttcaatcagatattgaataattatactacacagtattaagaatgagatagatattaatgtactgcatagaaaatattcaaagtataataagttttagaaaattatcacatatgtatattagcatatgcagagaaaacatcttaaaatacaaatttcagttttgaggtttggatcatggagtaactgcccccttttcaagtcaaacagttgagaaaatttaggataaaacaagtgtgtgctacctttgtaatcagataaagtattttaaaataattcacattataatatagaaatactgaaatgccaagaaaatttaaatatattaattaaaacctacgggccaggcgcagtggctcacgcctgtaatcccagcactttgggaggccgaggcaggcggatcatgaggtcaggagattgagaccaccctgggcaacatggtgaaaccctgtctctactaaaaatacaaaaattagctgggcatggtggcgtgtgcctgtaatcccagctactcaggaggctgaggcaggagaatcgcttgaaccagggagtcggagggtgccgtgagccaagatcatgccactgcactcgagcctgacaacagagtaagactccgtctcaaaaaaaaaaataataataataggctaccaattagactttatagaatacataaatatattaatatagctacaaagaggttgaagcttattcattgagacaagagtatttattgagcatcgactttattaaatacactgttagtaagataacaagtgaaacttgttaaaaaaaaagaaactaggacaaaagaaatttgagttgagttccccaaaaacagggaatattcagattgtaggggaaattgggtaaaggatttgtttcagcatgaaaggagcaaggagcaaagaaactaaatgggaggttatgctgagaagtatatcagtatgaggaaatatcttgacatctacagacaaatatttgttgccaattcattttgggcattgaggattcacaagaataattaaaaacacgtaatataaaatccttctgattagagcacattttatggcactgcataaagagatggctgtgggagtcatttatattttaatactaacttgaacaaggcttggttctgcaaataaaacagaagagtaaatatgaagtggagcacataataatgttactgtttctgtgggtgagcttccataggaaagaggcaaaggcatcaatctcaaaaagttagaaaaacccaaagaaagaagaagaaaaataacaaatgagaacaaaattgagaaaattgtaaataatatggtagagaagataaacaaaaccaaatctggttctctgaaaagattagttatgtgtaagtcactggtgattacagagagaaaagagggaaggttaaaataaccaaagtcaacaataaaaagggggctattactacagatgctgtagacattggaaggataatagaatattatgatcaatttcctatcaataaatgtgaaaaattagttgaaatacataattggaaaatataatttaccaaaactgtcaaaagaaaaaacacaaaacctgaactcctataattattaaagacattgattgaaaaatctcagacctcttaaaggacaactccaaaaataaaaaaataaaaaaaagaaagaaagttccaggccagacggatttatcagcaaattctaacatgcatttaaaaaaaaaaggatgccactcttacataagcttttcagataaaagaaaagaaagcttgataccaaaatgtagctagaaaattatttaaaaaggaaaattatgggtcaatttcatacataaacatagatgcaaaatcctaaataaaattctagaaaacaaaacccaacagtatatacgacaataatatatattgtgaacaaactggatttattttaagaatgaaagcttgtttcaatcaaataatcaaatttacattgtaaagaaaatttatataactttaaacaaaagaagaaaagcacttaataacattcaacattcatattaaaaattcttagtaaattagaaataaagaggaagtttataaatcctacaaattgataaaaggaatctaccgaaacctacagtaaaccacacattttcatgtcaaaactttaaaatttaatcatttgaagttgggggaaaagacaaagaagccccacatattaccgcatttgtctgaaattgaattggcagtcttagttagtaaagaaggcaaggaaatgaaatgcaatgttaaaggattgggaaaaagtaaataaaactttatttacagatgacatcatttttttacacagaatttccaagagaatttggaaataagtcattagaattaataaatgagttttaaaagtttgctagatacaaggtcaatatagaattttagttttatatatcagcataaacatcaatagaaatcaaaatttttaagtgatactgttttcattagcattaaaaataccttacaatatggacataaatctaacataatacgtgcagaacctctacaccaaaaactacaaaatattattaaaagaagaccaaaataaatggatagatatattcatggattgaaaaacttaataatcaaaggtagaattttcttcaaattgatcaatagattcaatgcagatgcattcaatatttcaacaaagtttttgtgaaacttgagtgattctaaaatatgtatggaaatgcagagtcaaaaacagacaagatgctcttaaagaagagtgagaaatacaaaagattatcagagactattacaaactggaaaacctagaggaaatggatacatttctgaacacatacaacctgccaagattgaatcagaaagaaactgaaaacttaaacagaccaataacaagtaataagattggataggaaaaaaaatctcccaacaaagaaaagtcaaggaccagatggtttcactactaattctaccaaacttagaaagaagaactaataccaatcctcaccaagccatttcaaaaaattaaagaggagagaattcttcctaattcattctatgaggccaacattaccctcataacaaaatcagacaagaacacaacaaaaaagaaaactacaggctgatattcctgatgaacatcacttcagttcagcatggatacaggccaatatttctggtgaatataagttttctagtattttgttcagcaaaagctatcaacaaaatattagtagcctgaaaccaacagcacatcaaaaagataatgcaccatggtcaagtgggatgtatcccagagatgcaaggatggttcaacatacacaaatcaataaatatgatacatcacatcaatagaaaaaaacaaaaaccatatgatcatatcaataaatgcagaaaaggcatctgataaaacttaacattgtttcatagtaaaagctctcaacaaactaggtacagaagaaacatacctcaatatattaaagtccatacatgattaacccacagctaacattatactgaacggggaaaggcggaaagtctctcctctaagaactggaacaagacaaggattctcatttttatcacttctattcaatataggactggaagtcttagccagagcaatcaggcaagagaaagcaataaaggtcatccaaactggaaaagaagtcaaattgtccctctttggagatgacatgatcttacatctagaaaaacctacagactccaccaaaaaactcttaggtttaattaaaaaattcagtaaagttgcaggatacaaaaaaatcagtagcatttatatacccaataatgcactggctgagaaagaaatcaagaagaaaatcccatttacaataggtataaggaaaaaatatctaggaaaaaaattaaccaaggaagcgaaaaatctctacaaaaaaactacaaaacactaatgaaagaaatggaaaaggacacaaacaaatgaaaagacactgcatggtcatggatcagaagaactaatatcattaaaatgaccacaccacccaaataaatctacagattcaatgcaatccctgttaaaatattaacgtcatttttcacaagaatagaaaaaaacaatcctaaaatttatatgaaagcaaaaaggagcctgaatagctaaaggaaccctgaacaaaaacaacaaaactgggagcatcacataacctgacttcaaaatatattacaaggctctagtaaccaaaagagcatgatactagtataaaaacagacgcatagaccaatggaacagaattgataacccagaaataaatccacatattcacagccaaccgactttcaacaaaggcatcagtaacatacattgggaaaaagacaccctcttcaataaatggtgctggaataattggatatccatatgcgaaagaataaaactggacctctatctcttgccatatataaaaatcaactcaaggtagatgaaagacttaaacttaagaccccaaattataaaactattaaaagaaaatagagaaaacatttcaggacattgatctaagcaaagatttgatggctaagacctcaaaagcacaggcaagagaaaacagacaaatgagactatattaaactaaaacacttctgcacagcaaaggaaagaaaacaaccagcagagtgaagagacaacctgttgaatgggataaaatatttgtaaactgttcatctagtaagagaaaatccagaatatacacaaaactcaaacaactcaacaattaaaaagaaaacttttacaaagtgggcaaagaacgtcaatagacatttctcaaaagaagacacaggaatggccatcaagcatatgaaaaaaaatactcaatatcactaatcatcagggaaatgcaaatcaaaaccacaatgagatatcatcataccttagttagaatggcaattattaaaaagacaaaaaataacagatgctggccagaatgcagagaaaagggaactcttctacactgtgagtgggaatgtaaattagtacagccactatagaaaacagtagagatttctcaaaaaactaaaaataagactcaatataatccagatatctcactactgggtatttatctaatgaaaaagaaatcagtatatcaaaaagatacttgcacccacatgtttaccgcagcactatttaccatagcaaagacatgaaatcaacctaaatgtccatccacagatgaaatggtaaacaaaatgtggtacatatacacaatggaatactatttggccataaaaataaggaaatcatgtcacttgcagcaacatggatggaaccggaggtcattatgtcaagtaaaataagccaagcacaaaggacaaataccacatgttctcactcctatgtgggagctaaaaatgttaatgtcatggagatagagagtggaatgatggttaccagaggctgagcagagagtgggagtggagaggaagagagtttggataatgggtacaaacatacagttagatagaaggaataagttctgatgttgtatagcagagtagctgactatacttaacaaaaatgtattgtatagttcaaatcagctagaaaagaggacttgcaatgttcctgacacatagaaatgagaaatacccaaggtgacagacaccccaaaaccctgacttgatcattacacattctatgcatgtaacaaactatcacatgtaccccataactatgtgtgtgtgtgtatctatctatctatctatctatctatctatctatctatctatctatctatctatttatagtatccatttttaaaaggcaaatcttaaaaaaaagagtgaggtaggacaacctgctctactaaacatttttataaaggcacagcaattaggtcagaatagtgttcatgcaggtagaaacaaatcagacaatggaaaagaaaggaaagttcagaaacagattcacacatatatggacacacttgatttttgacgaaggtggcagttgatttttttttacaaaggggcagagtagttaaaaaagggagaaactgttggtaaatgatgctggaaaatgagaaatccacatgagaaacagaaacttgagaagtaactcataacatcacaaaaattgatgtcagataaactataaatctaaatatgacaagcaaaaactatgaagtttctggaacataatatagaaaactatattcctgacttgggaagggaaagattttaaaaacaaggcacagaaacactaagagtaaaggaaagactaataaattgaactgcattaaaataagaaaaaaattaggaacttaaattttcatcaaaagacactattaagagaatcaaaaggcaatgcatggagtggaagatgatatctttaacacatctaatctactattcatatccagaatatgtaaagaacccccatcaatcaataagaatacacacaagtcagaatacacacaaggaaaaacagggaagaaactgcacaggcagtcataaaagaggatatccaactgctcattaaaaggtcttctacttcattagtaaagcaggaagtacaaattaaaacctgaatgaaataacaccacagatacatcagaatgtctaaaacaaagactaacaatgttggtgaagatgtggagcaataagaactctcacacacagctggagtttaaaaaacatccttatttatccatcagggctgtaataagaggcatatagcatattcaaataggtaagtgaacaaaatttaatgaaagaatttacaacggtaaaggtagaatttagtaaaaaccaaagggtgaggaagtcccccaggctagcaagaacaggaagccattactaccctcaggcctacaagggcaagggaggtagcagtcacgcagcaccggtagctgtgaacacaggagaggataaacaataggagctgtggccttccatggagggaaaaagtcactgccaacccatgaccaaagagagaaagctggagaaaaaaactccccaagctctctcctcctactctcaggcttccttgtggtgactctcatttgcttaacccaacagaagatagaggacaaaggagcccatttgatgtagtcgacagaagtcaaactcccaggacaagaggagcagagaaggatggagaatgaattagagaagtaaacaaagaaagtcggcacatctactgtcatcaaagactgtgtaattccactatttaatacatgtacaatagagatgtgtgtatatgtgcaccagaagtcacctacaagaatgtccactgcagtattattctctcagttaaatgctatatctggctgcacaactagattaggactgagaccctaaccacacatgtagaagcagggagaaagatgcagttgagaagccctttgccatctgatatgcttccaaacaagggaaactcagcttggacactgaaagcattttgtataaaatactgtttgtatgatatccccatgtcaccacacacacacacatacagacacacacacatacacacacacacaacaaaaacaaaaaaaacttccagggttacttttctcctcagttagcaggtcaaaacttttcacgtgtgaaatacttttgcaaggaggcagatgaaacgggggagaagggataaccttgccttgcagtcatctatcaattcactgcaaggaaggaacacagagcttagatatgaagcatcaggagttcttcccaagacccttcttgtcccttgggaagagccaggagctggaggggatggccttcactgagaagtggcatcaaattagaacctgcacaacaaataggaaccagctacttaaagatccagagaagtagccctctagactgaaggatcagctcctcaaatatcctttttgattttgaactcacaagttcaggggcatccgaggaacagacacaagccagggctgaacaatctcatctgtgtccatgaggtgggcaagagccagatcctactgaggagtttgaacttaatcccaaacatggcgggaagccattggggccaaagatgaattagggattgtctgatctccttgacacgttctgaaggttttgtgtacagaaaaggtttgtcaacatgcacaaaggaaagctgggataaccaagctaagacgctaccgcatcattctaggggacgggtgactcattccaggagtttctgcaggaagacctatcaggactggtgattgactggaggcagagagcacgaaaaaagaacaatcagagatgatctgtggtttgtggttgttgtgtaatgttaaggcttaacaactgcgaaaatagtgtttttactttacagagaagaagacttgaagaatacaagattggggagagcagatcgggatttgtactttatatcagacgtgctcatagatatacatgttgagatatcagttgggagctggatatatcaggattcgagactgggaatcaccagtttatagatggtttttaagccatgtgattggatctcatttcttagtggggagaagtgagataacaaataaaagccaagattaaagctgaaccttcagcctgcccatcacttagaagcccagcagggacagaagagccagccgacagcacagagtcgaggaggaggatttccgggcttcagtgagtgtgcatcagagattcatggacacaacttaaagtaagaccagccacacagttcccttcattttctcaagcaacattcagcatctcaaagtgcggctactacacacggagccaagccctggtccagttatcacaaaaccttactagatatgtcgattattagctgcattttatagctaaaggtaggcaggcacagagaagttacgtctcttgcccacagtcacagcaagcaaacagacctcagaccaaagtctttctaactccttatttcacatctaaaacactatgtgacgccacctccaaaaaatgtgggggttactctaggacaaaagaagctcatgaaagcaaagagagaagcatagagcttaaatttagaacaatattcagggtgattgggaaaaatagcctccatacaaatataatcggttcatcaccaggtgaataaaatgagagaggaacctggtacaagtgaagttcattgaatttgcttgcaaaaaaacataattcaagtgtggaagtttggaaactaaaatagtaatcagctaaagaaattttcaggccaacttagacacaatggtgacaaagctcccctgaggagacaggaactatactacttgcaactctaactgaatggacttaacttagcaattaagatcaccgtaagtttgatcagataagtattaaagggtgtcttgggtacatttgcagattcagacactcttagttgtgaaattcttcaccaaaaatttgcaacttatggcttgcacattaaaaacatgatatgaatgaaattcagatatctcttggtaaattttataattattcctcccatcagctaaagttctcagtatgaagggttataactgatgtcatatacaataactacaagctgtatcatacaaaaattgagaattttctattatagaaagagttgctttaatctaaacctaaagtagcatcaataatttttcgtaagtggtccccttcctatgagtaagcccccaggaaaaataaattgcttttaagaaatgctgtaagtaagctgtttcatatataagttttgacaagatctggctacttaaattacaagatataaaatgagatttgtactttttctcaaatgtaaaaaaaaagatttacttctgaaataatggtctttataaaatatgcatttttgttcctttttcttatcatatctataaatttactaataaaagattctatcttgatttactaacatttgaaaagattgattatattggtattgcaagaagaggataccataaattaaaaatccatatattaaccatattcttttatttgcaatatgacaaatgattgtgtaaagttataatcaataaaagctatttgaaagtcataaaatggatattgccataactgctttcctagcaaggttaaaacactttaactatttttaatcaacttacagtgtagtagatcaagcatatctaaatattttattttaatcaagcaaatatatttctgctgttcctatgacagtatgaaagtttggttcaaaatatttccaaggtatttaacacagttcagtagaggtcctgtctcataaatcaatttcagattagataaaaggaaaaagcaaattcttgtttacttcagaatttttcaagccagttccaaagacagagttgttactctcatgtgaattttcagtagaaagctgaacaacgacgttgctctgacaatctttttaaataccatatgatggagacagaataacaaaaacaaagtaggtataagctgtacgaaattatttctcttggacataaaatatgtttggggaagaaatgcattgttccatatggactagggtagttacttctcaaagtgggagcaactcagactctgaaaaatggtttctcaaaggaggcattgtgtctgggtgaggccagttttctagtcaaaatcattttattaaatgccattggattgaatgcttccaggtttgctctctgaaatatgccctatcattcttaaaaaacacacttaggtagcaaaaagggcacactaaaaataacgtgggttaatgtttctatcctgcctgtgttttctaagtagcccctgcctgagctttcgacttttttaaatgaaccatcaaatagttggttgtctatcacaaataagccatctattttgttattcctgtaactttttgtagaatccagaaagtaacattcttgctgatatatcttatataacaccaagtccattttccaaatgaggattccaatgagtattcatcaccaacatctccccgaaaaatatttagaaaaaacagactcaatcctttatccaaagtcagtgagtaagaggcgggggccagggttggacaaaaatctctttggccaggaagccggtggtcaccctgatctacttctctaagctcccacccctgatgaatgttcaatatctgagtttcaccccactcattattgtaattctccgtaaaaccccagttacccacacggaattctcatctacatctagcccaatttgctactggatttcaatgttatttcatatgaaaacaatcactaacagaaagaacctggatctggtttcgaaaacataatttgaaaggaattcattctgaaggctgcaaaagcccagtgatggcccatcggtaccctgaatgggcttctcaggtgcctccactctcctccgtatgtctccatccatctcagaatacatgtctggctcttcctgctcataaacagaaacagagagttccgggatccaaaggcaagactgcgatttaagagacactttgtttttgtaggtgttcaaggatttggaatcaaagcagcagaattattaaaattaatccaattttcttgcatttattttgttagttcatacctctaaaagatatattttggaaggcacccttcaacccacccatttacaaatcaaagctttctttggaatccctgagaccaaacccaagctagacagtgacacactgccagctccagagccctgcccacctggaaggggtatggaatgcactatttgacttgagctcacatttaattacagtgtcaaaaatcaaacttaaattgctttaatcagctgccaacactatgagcctttctggcttgaatttctataaacaaagaataaattcaaatctgtcacaaagtggcagcaacttgttgaccactggactaggaatcgttatgcaaccatggctcactgtggaaaaagtcaacatcttcctatatgtgactcttttctgatcttttcggactattagtcaacagaatcatcataaagctaaattatctatctgcactgaaattactcagcctcagacatccaaaccagtagctgttcaccaatgaaacctgaataaagctgttgctgactttccctgcttcaatttagagtatttttggaaacatcattgcatgtttaaaatataataagcaaaaggacctttggtaattaaacattctgtaatttaaaactccaagagacaggagcagtgataagatattagattttctttactggggtgaaaaagacagaaagtggttaactgtttaaaaaaagaaagaaagaaagaaatccaaggatttttagagccagaaacagtaacagtgtcctttattctggaaatgtttaaaagcctgtaagcagagatcacccagttcatcctgagcattggtgagcaaataacttctgaaatgctcttgaaagagaattctccagccttctctgtttgaaatacttcctaaagcaaacacaaaagtgggcaaaacacaagagctcatgttaattccaaacaaagagaccaacagtcgcaaattgagagtccatcttagaagcgggtgctgcttccacatcaagcaactattggaaagagtaggggtagatgcagaattaagatcatttgtgactacagaaagagacaagaaaattaatttttaaaactaaaagagaaatttatttcagataatccaaggaaatgagcagagtcaacctaacaggattctcaagcccctccctactggtgtggtgtgaagatcacacgtggtgtagctgacacccctcacatcttccccgcgcccctcctgccacctctttttggcattcaccctctctcgggttctgtatccctgcccatgttctccatgaaaggccatgttaatgcccatgctctttcctgcctctaacagacgatgccttccacagtcactcaagctttaaccctcttctggattcggacctgtacatccaaaagcctgccagacatctcttccagatgctctcagagcacatgaccagaagcacgcgcaaagctctcctgagcctcagtgctttccctccaacacttcttccactctctcagttaccgagccaagacacagagttgcttgtgagtcatttctctacctcatcccccacccaaccttcctgcgagatcctgctcacgttacctcctaaatgctgttacgtgacttcaaccacgtcagctttttatgggggaggagaggcacctgcatatctgtgggagcaccaacctctagacatctcctgccaagttactgcaatgtgcagaaaagaggaagaaagcaagcccaagtcgcaaagtctttgccagtccttctaccaaccacaccttcggtggagatgtgggtctgtggaaatgcagagacggactgaaagccaaatgggccaatgagagctctgaacaaaacattaagcttgtttttctttaaggcaatacgattaacagtggtccattaagaatccgtttaaaaaaaataataataatactttttctgactattgttggggaagaataactcctttatggggagtatgaactcaaagacatgatattgtaaaggaggccttgaagaagagagggactaagaaatgtgatggcgtggtctgttacatgtgcaggtgctgtgtgtgagggaagcactgaggaccactggaggatgagggatgctctgtccttctcgggtatggctgaaggacagggattgcccatcaaggagtaaataatccatgagtggactaaattctttagaaacaggaactcaaatccagtagggattaggataaaaatgtaaactctaatttgcacctctccctctctcccctaagtagtccgtttctataattttatactaaatcaattaaatgtatctgctataatattaatcataattttgtctgaagtagtaacaactggaaactacctaaaagagtcagagcaggactgtaagactatattgtagtctacactatgtcacagcggactgcatcatgatagagaacgatactcatgatttaactgataaacacatatggcaatgaataaaactgtgagtaagatgtctttaattttagcaaaattatcttcattctaattttcaagtaaacttaaagatttatatataaatgcacataatttaattaaaatacatgcatatattaactagaaggctaatcccccaaaatgtccatagatgttatttctgagtgaggagggtcaggaaggttttaattttctttgtactaactctatttactaaaatgtccacctggattaacgttataataaaaatgttaccgtttaaaataaaatgaataaaatacaccggtatgaaggtattattagaacatacgaaagtacaaaatcaagcagcaaaaggaggaaattatattaagaactgaaaaaactatgttgagaattctgtctaagaaacgctgtagcaattaagaaaaatcccagttctgcaagtaatgggagaaagatgatgacttccagaactttcaccatctactaagatgttcaccaattcctaagaagggactgaatacgtctgcatcctcagatctgagagtaattttccacgacgcatactgagcaccataatgagtgaagtctctgagatgacctctctgacctctctaaaacaatcaggcactgcaaacatggcctatcccacactagcccttggtgaaattcaagggcataatattagactgaaacagtgagaagaagattcgacatggagtgcggcaagaatgtgttctagtccttgaaggccagcgctattccaagtgtggtctcagaccagcagcctcagctgcagctgggggcttggaaatggaaacgtatgtgctacgtcctggacctgtggaatcagaatctctgaggtggaccaggaatctgtgtttttaaaaccctgtggttggtaacttcctgctggctgaggacagagagaatgcttagtgaacgctgaggaatgacgggttaaataatccctgaatgattcctgagcggatcaatttctcagccagagttttgaccgcagctgatgatgaacagggctgtgaccaccaggaagggtctgaagaggaggcgttgattgcagttttctgcctctgatcctcaggcatggagccccaccccccaactctcttacacggaggccaaagaaaaagctggaattctccaggagagcaggacctgttaaacagcaaagggcaacccaaaattgtatgagtggccttgccctgagaagctttgaagccagaggttactgaacaactaccctggttaaaaccctaacgtgacaatgataacatgtgactgtatgtggctgtcttcaaaacagcaatgatttaggcacaactgtggatctcagattgttccgtgagtttggtctgataagattgtatgcgtttcccaggggtgccataacaaagtgccacaccctgggcggcttccgccaccgaaatgtattttctcacagctctgaggtcgaaagtccaagatcaaggtgtcagcagggctggttccttttgaggctgtgagggaggatctgttctaggctctctctcccccagcttctgggggctgctgcagtctttggtgttccttggcttatagaagcatcatcccaatctctgcttttgcgttcacatggccttctcctcatatacctgtctgtctccaaatttcctcttctcataaggacaccaagcactggattaggggcccaccctactacatctgcaataaccctatttccaaataaggtcacattttgagggaccagctaaatacaaaacattagccaggcatggtggtgggcacctgtagttccagctactcaggagaatcacttgaacctggattagaacttcacaattactgacacgattcaacccatattaggttgtttagtattatacattaggaagccatagcaaacttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcccatagcaaacttttgtaaacataactatttattaaaatttggtataattaatatttaaatatcctttctggcaagatttagccagttttttaagcttcattgagagaaccacaatattagcattaataatagaatggtctattaattttttaaaaagatactatgtctgcatttccaatataaaattcacagcaatgattcaggtagaaattaaatgaggatgtcattgtcaaccttttaaattatattacaggagcagggagcacacgggccctgaggtagaaatgaataaggaatattctagaaccaccaagaagccagtgtggccacagcagagtgagccagtggtgctggaggcaggtgagatcttgaagggccttggcaacatgaacaggagcttggattttatccacattgccgagggaagtatgaggtggtgtttagcagggcataaatctcatctgatctgtactttgaggaaaacactctgacttctgtgtggagaacagtctataggaagccaagaggagaggcagggagatgagggaggggtgacttcagtctccaggagaatgagctagtgatgtgaattaaggtgctggtggtggaggaagtgaggtggagaactggacactgggatctattttgaagagggagcctacagaacttgttggtggatggctatgagggaaagaggattaaagaatgatgctaggcatttgggcttaaacaaacccctgagtaaatggttatcctattattaatactaagatgggtaatgctagggaaggagtagccttggggagcagtgatgagttattttcttagagagaagccacgttacctataggaggctcaacagagtatcaaattagaataaaatatctaatgttctgatttgtgtctttattttttccattaagatacacatggctggccaggcgcggtggctcatgcctgtaatcccagcactttgggaggctgaggcaggccgatcacctgaggtcaggagtttgagaccagcctggccaacgtggtgttaccccgtctgtattaaaaatacaaaatattagccaggcatggtggtgggcacctgtagttccagctactcaggaggctgaggtaggagaatcacttgaacccaggaggcagaagttgcagtgaaccgagatcacgccattgcactccagcctgggtgacaagagcgaaactccgtctcaaaaataaaaataaacaaaaaccatgggaaagaacaattgaggaaactggggacttgtcctggaacagaagacacgaggacttttggttttttagttttgtttttgtttttgagacagagtcttgctctgttgcctgagctggagtgcaatggtgcgaactcagctcactgcaacctccgcctcctgtattcaagtgattctcccacctttgcctcctgagtagctgagactataggcgcacaccaccatgcccagctaatttttgcatttttagtagagagagggtttcatcgtgttggccaggctgtcctcaaactcctgacctcaagtgatccacccgcctcggcctcccaaagtgccgggattgcagaagtgagccactgcgtccagcaagaatgaggtttgaagggaggcatgattgtgttctcttcaaatagttgaaaggttccatttgaaaaagggatttacttattcctatggttctagtaagttgcagagggtggatctaagaccattgggtgaactttacagagaggccagaaagccttctccaggggaagaaagtcaagaaaaggtctcaaaactgtctggcagaattctgcacaggagagtcctcaattcggtgtagaattggcaagtataataactgtaaatccctctcaatctaccatctacatcattaggcgacatcttcatttcctgaaaattccaacacatgaaggctcacttactatcaagatgagcaagtttgtgctacatagtgaatttgatttcaataggactcattttataccttttaagagtctttaaaacgttgaaaatgtaaagatctgcaagagcaactgatcttcaaagtcccgtcgagtcacaggattttgtaatgatgtctaaagaggaaaattcccatttcagaaaaggctcaatagtatttaatagttagctcaaaaggacgaataaagttctacatgggaagctgctgaactacagtcaggccaaaccttcatactcggagaagatgactgggcctgtagacacagatattgatgataaatcatcacaaaccacagctttccttaattggggtggtgggcagggagagcaggcttcaggttggccttcctccagcaagggcacacacacaaaggggacctgaacacgtggagcttatggtcaggaagcctgaagtgcctgacccagcacatctggtgactagtagtgtagattccccacagaaggaatgacaaggcgtcattattcaaagtgaccttccctccattggaataatcagaaacagctcacaaataaagtaatctgtaagatgcttcatcttctctaggtaacctctccccaacatgatgacatcacttcacatgaggcgacatggttttgtgaggacttttctttccttccaagtttggaatctggctgaaggctaaaatcaccatttacagtgtttgagccctccttcacactttgaagaagggtctgtgtaaatagccattcctacttctcagactcgccagaggcaaaacctgttttgctttggtagtacacgctcttccttaactggtaaaagactttaaaaaaaaataagatgccatttttaattgtttcataaatctggcttagatatattaaggaaattgctattttatatgtagaacagcggcaagcaaatctcaagagattaaaaatcatgttcttgtggttttcttttagaagctgcaaatttgaattcaatttaaaaaatcatggcacagggacaaaataagaatgaacaaagatgggaaaaatgtccgcagcattctgcagagtcaagcgctgctgtgagtgagtgtgcatgtttccaattacacatcagggcttggcgagctccaggagtcaaattcagacagaacccaagtgcagtgcgttacacagaacccaggccaggaaaagcttcacagagtctttctttcaactgaggcaattgtgtagacaatttggttcatttcaagaaaaaaataaaactgacagaagaaagaaaaatattattatattttgcctctcaaaacaaagtcaaattgtgttggtgtataaatcaagattcagtatttccttggctgcttccagaataatagtagatcacaaagagaataagaacaagaaagttcagttctcagccagacgatccaaggtaacaaagggtgagaccctcattccgttactcacaggagcaaacagacaaccaataataattgggcacatgggggtttcaacaagataaactgttatgtgagtccagggtgctaatttctggattcttttgagttgcaaggaaaatatataccgattccccacccccacccacccacataacaagacacaatagttaacagctggaagactgtggttagggggaaatgtgattgtaggcttccatttcaaatgatggaaaatcatttctgaagtcactacgaaagttacttcacaaaactaaaagaagccttgacaccttgtgttatcccatcatctaaagcaattctagtttggaaacacttgattcttggcaggggattctaaagaaggtgccgtatgtgaaaggctggtgtgtcagaaggagctttaaggaactggaatgagaacagccaaaagctaagatttctgattataatcacaggtctggatgtgttcaaggtaaaaagagatcatccccatcatttgcaatattttcaagagaatggggctttagtgacactgatcaaagtctgacatggattttcagctgccttccaactccacatacctgcaattcaatgatctctatggatagtagaagtaactgccaccctgatgttctcatcggtgatttatacgtgaagtggactcaaaagaaatacaacgaaatcccttaataaaaattatgtccattgacccaacaagcttcccagtgctgtatcagttctcaaccgattttagagacatttggtcaaaaatgatctacttgtaataagccatctgagggcactagctctttttcacctctgtgttccttgaagcaggaagtcagtaaaatcactattgaattaaaatgaagtaaagcactttgagatttcagatttctaaattaaggaacacacaacatacggtactttatttgcacaagaattattagaacccagggctaacacccaaatgaggtcacaggtaaatgaaaatctgtctcagttatttgaactcaggtcaacacacagacagagcaaagcaccagctgacctctgatgcacaacccagtgttcttaccatagaattccagaaggcatctcagtcattctcttatgtaaatacaaagacgacaactggtttaaaaattcatttatttttattttagcttctttgtgtcaaactcaaagaagcctcacataaatgatcaaagactttttggtggatcttccaaacgtacatgccgggaaggcctgcttgcactttttccttcaatcctctaaaatgaaggttttgaagatgcttgccaatggaacgttgtgccttacagctataatattttttaaaaggcattcagtttaaattaatatatttggccagacaactgtattaaaattcttgttgttttttctgttataatggtagcctgtggtatgactagtcttcttcaaaaatatgtacagttattgcttctctcttgcctggggtatatcatgtgtttttcatttgagtgtacattgcaatacctcattaaaaccaacacttaggctacacaaaagtcttcatatcatgccgcaaagggcgtaaactaacgtggaaagtttcagagcctcataactcattgcatatacctcttatactagctgctcaactgatatttagctctcctggatgatgtcacagtttttatcctcttaaaatagcctgccttcagaaaatatatagtttccttcatgcactaatcatggggagttacgatgtaaatagagccattttttttcttatacaaggaacaagtgctctcaccctcctcccttctctccctccccatacacagaagcacacttcacttcacttatactaaacacttcacttatacttacactgcaacaaagagttgcaaatacatgcaaataaagcctttataactcccctctctcctgctggacagctccttgactcaagtatttccgaagacagacactctgataagggtctgctctgagcttcattctcagcatacagtcctgggattatttacctaccaatattcacctctgcatgaaccagtaagtcattactgacaagaaaaaaacaatttgtgattttttttaatgtcacaatttttctttttaaggtttgggagagaaagttgttttgaatgtttcatcagtttctattgccaaatgaacacctgtttcagagtccctgaaagtcacacatcagaagcttctgacttcaacatatagtctgctttgaagaattattttaaaaaagcattgactgcttgaagataagcaagtgacactcaatagcttcattctttagtcttagaaaataatttttacacttcacacctattaggatggctactatgaaatataaaaaaaattaaaaataacaatggtggcaaaaatatgaagaaattagaacccttgtgcactgctggtgggaatatcaaatgatacagcctctatggaaaacagtatggtggctcctcaaaaaattaaaaatagaattaccatatgatccagcaattctacttctgggtatatattcaaaaaaatttaaagcaggatctcaaagagttctttgtacagccatgttcatggcagcattactcacaatagccaaaaggtcaaagcaacccaatcgtccatccacagatgaatgaataaacaaaatgtggcatacaataaaatgtcattcagtctttaaaaagaagaaaatttggacacattgtacaatatagatgaatctttttttaaattaaagtggtttttttaatcgttttattttaaagttccgagggacatgtgcaggatgtgcaggtgtgttacataggtaaacgtgtgccatggtggtttgctgcacctatcaacccatcacctaggtattaagcccagtatgtattagctattttccctaaggctctcccacccccaccatcccccaacatacaccatagatgaatcttaaggacattatgctgcgtgaaataaaccagtcacaaaaagacaaacagtgtatgattctacttatgtgaggtacctagagtagtccaagttcagaaagtagtaataatggttgccaaaaggtgggagcatgcagaacacggggagtgttgattgacatcaagtttctgttttgcaaggtaaagaagttccagagatttgctgcaccaacaatgtgaatatacttaacactactgaactgtaaagtggttgtgactacagattttatgttttatgtgtttgccacaaccaaaaataaagattaaattaaaaaataaaagattttatagcacctatcacttaccaaacccactgtacatcttacactcgtgaatattttatgattttcaaaacacctttatttttttcccttatttgttcattccttcatgtataacccacaatgtgttaggttatgtgctgggcagcctggaagacccaaagacgaattagggaagtaccctatatttaaagccttgcaaggacataaatatcagtaatataaagtaaaatatgttcactgctgaaaactgctatacttcctagatttttcaattcaattgcaatttctaatattttgccatgttgatcccacaaattcacttgtgtttaaaagttaacgtgcttgattatcatacagctgcttctttcataagaggaatacagataaaacgctatgggatttcagggggagaaagaacttcttattaaattcatattttcaaccaataagaaaacacaattttttttaatcaacactatcttcttggtgcttttttcacatctcatcctctttcctcctttaccctgcctaagcaaccatttctggacccaatcttgggttattacatctgacggcaagtgttatgtgggccatggaccatgagcaattagccccctctctactcctagggatggagtacatgtgatgatttccatcagactcagattaaatatcttgctggtaagttacccctaaaaatcgattaatggactctccaggtagacactgaggtaatctccaaccaaacctgacttatacttaggggctttggaagcccaccagagtcatcaagccatatctccacctaggctctatactggaaagctggtcagtagtaacacaaagaacaagccatttgggaaaacagcccacatgaaaagaactgtggtttcaagaagagtcattccatcccaggtttaaaatactcttctcctctttatctaccttgaggactcctatctatccttccataccagatccagcctcatcttctaagtgaagccctcctctgggacgtcagcgtctcctctgcatcccctagcattttatgcatcctctgttaaagcaactgtttgcacagctgtatccaccactaaacttagaggcaacagaccatggttttgaatgtgtagaacccaacacagagcccgagacctagtgggtattcagtgcatgttgaagggaagaatgaatgcatgagcaaacaagacaatggaagtctgtcatcagtatttacatttcaaaatgcaaagtgaaaattgtgcaaatctctaatcaagctgtactttaaaatgctaaattgatttggctaaaaatatttcaacactgaaatttctttttgcaagttaagtcttcgcataaccaaaacagaaaagaacgtatcaatgaactaaatagataaatttatggctgacaaaatctcaagatttagtgtgtgagaggaaagtaaaattcaatgtgtccttgaaagttctggggtctaagatatacaggccaatggaatagaatagagacttcagaaataaactattgcatatatggtctgataacttttgaaagtggttcaaagatcatttaatgagaaaaaaaggagtcttttcaacaactggtgttgggaaaactgggtatacatatgcaaaagaaaaaagttgggctcttaccttatactatatacaaaaattaactcaaaatagaacaaagaccaaaaaataaaagctaaaactctaaaattcttatgagaaaactctaaaatgcttagggaataacttcataacactggatttcacaagcctgtcttgaatatgacaccaaaagcacaggcaacataaataaaagagacaaatttgcctgcactaaaattaaacacttttgtgagtcaaacaagctatcaacaaagtcaaaagacatcctataaaataagagaaaatatctgaaaataatttatctaataagggattaatatccagaaaaaaaaatatatatatatatgtatataacctacaactcaacaacaacaacaaaaacaacccaatttaaaaatgggcaaaggacttgaacagaattttttccaaagataacactaatggccaataagtacatgaaattatgctcaacatcactaatcattgggaaaatgcaactcaaatccacaatgaaatacttcgtagccattagtatgactattaccaaaaaatcagaaaattacaagtgctggtggagatatggaaaagttgcaaatcttatgcactggtggtgggagagtaaaatgggaaagtcactataaaaaacagtctagtgattcaaaaattaaaaatagaattaacatatgattcaccaattccgcatgaagatagcaggaaattgaactgatatttgcacatccatgttcatagcagcattatttacaataaccaaaaggtggaggcaacccaagtgtccatccacagatgagtggataaacaaaatgtgatatacacatatcatgggatatcttcagccttagaaaaggagagaaattctgacatatgctataacacagatggacctttggaaagttaagagattgtcttatttatcttacgctaagagaaataagccatccacaaaaggacaaatgctgtacgattccacttgtgtgagttacctagggcagtcaaattcacagaaacagaaagtaaaatgatggtttccaggggctgagagaagggtagaatggaaagctattgtttaatgggttggagtgtcagtgtaagaaaatgaaaaaagttctggagatggatgatggtgagttttgcaccacaatgtgaatgtatttaataccactcaactgtacactaaaaaatggttaggatgataaattttatgtatattttactataacaaaaagtcataaaaatcaaacatggttcttctcattaaaaaaaaaagaagattcctgggtctagttggttctccctccttcttagttcttggatcaaggagatagaattgtgtccaaagtgaccaagtgacctacggagtaatgggcttccatctagccactccctgctttatgactgagctgcactgggagaggcattgtcaggggaaattccaggtttctagaattggtatctagccagaatttgtcccagggctaagtggctaaggcagtgaactagtctgtcagcttctctgttttaaatggagtcatgtaattccattacataccctttgctttcaactatatggccaaacatgactggccagcaggctgggggacagaagacatgtgggcttgtgcttgttacctggaattgaaaagagctcttggcatggttcttgttcaagctccatggttgactagcacatgaccaccaagagagctactgtacttctccgagactcattttctcttctgtaaaaaatgactgagtttctttcacagtgcataaatcttttcctccaggaacagagactgcccagggcctgtccaagacaactaggaaaccagagcagcagttaagccattcctgggcaggaataaatgagcagatgtcagctctcagaatctcagttttctcactcataaaatggaaaagaatactatttcttttatgtcattcaccatattgtgagctgaaggcactttaacgatgctgaggctgtaaactaatgcataatgtgatgtttatcattcttcacctatgttttagttactgagcatctcctgacaccagagaggacgcaacaaaaatcacaactcctagaactgcacagtctaaatggcaaccactagcccctgtgacaactgatcacttgaaaagtgagtagtccaaattaagatgtgctgtaggtgcaaaatatatgctggatttggaagatgttctatgaaaaaagtatctcattagtcatttttatattgattacatattaaaaagattccattttggctatgctggactcttcagatatatcctgggagattgtattaaaagaaaatacatgatggaaattagtgtaggtagttactagaaaatgtaaaattacatgattcacatcctatgttcactgttctagacatataaatataactttgagttatttttaagcatgagaagacagaaatcgacgaataaagtgaaaaagctaaagattaaagatacttacaaatcattgttgtattttttaagaggtcattttgagcatattccttaccattgaagcccctgcctgtctggctcctctgcccaccttgttttgctaatgggtcatgctcctatatgtgcatagacgaggagcggctctcagggactgaccgtaagcatagtcagcacagcacgtatacccatgctctgaccccaggttggcgtcttggagggtgaagcattttcccagtccttctttgactcatcacagaggtataaaacagcgtctccaacacgtgatttttttttttttttttttttgagacagagtcttgctctgtcgcccaggctggagtacagtggcacgatcttggctcactgcaacctccaactcccaggttcaatcaattctcctacctcagcctcccaagtagctgaaattacaggcacacaccaccacgcctggctaatttttgtattttagtagatacggggtttcacaatgttggccaggctggtctcaaactcccgacctcaagtgatccacccatcttggcctcccaaagtgctgggattacaggctgagccactgtgccagttaaaagaaaaaaaatattcaaacatatttggtttcttattgaggtgaagttcacataacatgaaactaacagttttaaagtgaacaattcagtagcatttaattaacaatgttgtccaaccaacacctctgtctagttccaaacatttttgtcaccccaaaaggaaaccacgtgctcagaaggcagtcactccacatcacccctcttcctagtcctatgctttgcacacaactgactcaccctgacagttataacctaaaagttaaataaaattattagtaaactgcaaacccctggcaagtgaattacttaatatctcttaaaatcctgacatcaaatgattcccctgtgaggccatgagatgataagaacatccacctccctctcttgctccagtggaatgaaaccccctcctcaaggagggttacactcaggcataggcccgatcactcatcatatattgacagatgtgcaggcctgagaccccgccttctggagctttctaatgctccttgtttctcaatccaatccttgctaggaattaggctcttctgctgaatgtaaaatttttccatctgcctccataaagtatgtgccacctgtcagctgactggtcaaccccaagctcaaagtatatggacattttgggggtgacaatggtgggcatacatctttagcaaagattaagaaggtaccagaggaggaccagcacaacccagcaatgcagcagaatccatcaggaaagctttggctctgggtggagctccttgctttagctctgcctttgagcgcttgggtggctggggaggcactggggtggaagggaaggaagcaggaattcgtgtgctgcaaatttcactacacttgaccacaacttggagtggaaagggcactgtggtacgtctatctggccttcctttacaagccttaaaatgctgtggaatccatctggatggaagacgccatccaattataaatccttaggatactttttattgccctttaagagttccgatgcttgctcttccatgcccatatgtttctgcttaagaggcttcattcaaatcaaattggaagagaagtccagattacccaactacaattacctgagcaaaaatcccctcaattatcttggtaatccagataaattcggagtacaaaggtgagttgcctggatagcactggctaagaactgctttgtctcccatttcaccttgcattattataatctacttgattacacttcatttataacaatagggagggcttgttttatgccacacattgccacttgctcaagtgtaaaataaaccttaaatgactgatgtactgctaaatttatctcaaaaaacaatcataacaggaatcttaaggcaataaagtcaaacaaatagaattttacagaatttaaaaattattttgtgagtgatttatgctaaaatacctcaaatttatttcaaaaacagtcttacttaaaactgacttaaaatatatgtaggataaataatttgtagtgaatttaacgaaacttcagcaattcaaatgaatgcacattattcttcttaaaaacagatatcctgaaaatatccatcaggataaatagctaatgcatgtgtggcctaatatctaggtgatgggttgataggtgcagggaaccaccatggcacatgtttacctgtgtaacaaacctgcacatccggcacatatatcctggaacgtaaaattaaattaaatttttaaaaagcagatatttggaaagtaccaatagcttcaaagtaaaaatactctacactgtttttgtttgtttgtttattttcgtttttgtttttcttttttgagatggagtctcgctctgttgcccaggctggagtgcagtggcgtgttctcagcttaccacaacctctgcctcctgggttcaagtgattctcctgacttggccgtgccaccatgcccagctaatttttttacatttttggtagagatgatggggtttcactgtgttggccaggctggtctcgaactcctgacctcgtgatccacccgcctcagcctcccaaagtgctgggattacaggcgtgagtcaccgcgcctggcctatgcactgttaattttatcacgacagttataaatccatcaagatgtcctgtgatttttcaacacaaattactcaaattatgaacttctctgtgtgtattttccactggcttgtttatgaatcctgctgatatgtctgctacaatttctccaaaggctaaaagatgtttacaggacaaatgacatcatgaccatgtcaggcttaaatgtgtttatatcagttgggtttagagggtcttcaaaacatggctttaaaatctcagttattatggagcttaatgtgttcctgatgtttctggagtaatgtatttctaaaaatagagaaatagattggttaaaagaaaatgaattgttggtctaatctgtcttatgcatggctaacgaaatgcattttcactctcttccgtgataatacgacacttaaaactgtgaggaccaatggggtgataagagacaaaataaacagtaaatagatactccatgtgagttactactctgtaatagatagaaaagatattttatagaaaagggaaaatacccacagacatataagcaatgtcctgtggttgctatcaaatttactgttagctgtttaaaactgccttaaaggttttttaaatgtgtcttttctaccatagattctttagacgacagccatcaagcagcaaatacctcgcaggaggccattgtgtttctatttgaacttctatggatgtcaagctctgttcttcaaaatttagccctacagatgggtggcccaccggagagaattaatctcactatgcagccaacactaccctttctggatctttccccagtagtgtggattctgctctagtccagaattatgcagaataagtatacttcatcttagacaccataattcttcaaatatctaaaatgtatattatgctctccaaatcctggtcatctccaggttaagtatctctcaaaaacagtccatcagataatatgattttaaatctttatccccttggtcatatacccacaatctcattctatttaccaatatccctactgatgcataaactacatatgtatatgtgtgtttttttttaaaaaaaaagcaattccactgtaattttagcagaggttatttccacatagagctatgtatatgtgtatatacacatatctttatattatatagttttctgtgctttcccagttatctacaatgggcatatatgacttttatagccaggtaattcaatattcattcattcagtgaacatcattgagcatccactatgggctgggaagtgaggatggagccacaaacaagcaaaataaaaacccctgctcttgtggagttcccttctcattggaagagacgtacagtaaagaaaaaaataaaagagtaaagttaatagcctgtgagaaggggatataaaagtgggaaggaagacagggtgatgtgtgagaaacactttttttttttttttttcagatgaagtctcactctgttgcccaggctggagggcagtggctcgatctcagctcactgcaacctccacctcctggtttcaagcagttctcctgcctcagcctcccaagtagctgggacttcaggcatgcaccaccatgcctagctaatttttatatttttagtagagacaggatttcaccatgttggccaggctggtcgtctcaaacttctgacctcaagtgatctgcctgccttgacctccgaaagtgctgggactacagcaatgagctgccaagcccggcctggggaacactattgaatagtgtggtcagggaaggctttactgtgaaggtgatgaagacccaaagaaagtgaggaactaagtcataaatgatgggtagaacattccggattgcgggagcagcaagtgcaaaggccctggggtgaggaataccaagaatgtttgtgtgggcagagcagaaagaaccaagggtaaagcattaggagatgaggctgaagaagtaaccgggatcaggtggttagggccctcaggccctggaggaaggctggcagcgctggagccacatggactgacaatgtctagcagtcatcccggctccctgtgaagaacagaccctcgcttgcagagaagcgaggacaattaggaaagcagagtcatgatccacgcacaggatcacggtgacttggaccagaaagagagcagtggagctggggagtgactcttttcagtatttctcaggtggtaccagtgggatctgcagagaatacatagttaaaggaaatgtctggaactaaacatgactcttcaaacgtgatcctactgtggcagaagagaggcgactttacatttcctttcccaggatatcttattctaatgaacacagaaaccgtaaaatcaagccaaccaacatgatgaaaatgattatataaggtacacagcccaggctggatttgaactgatgagggaaaaaaaatctctagtgaaaattcctctctctaaccacagccttctctccttccatctctgcctcacccttgctctttctgaagccttcctggatgctcatgaagctctctccttctttgactcatcctattttcccaggacctttatcaactcagggctcttctcccctccccacagtcagctcactgtgctctgactagttccctgaaattgctcatcctcttactaaccaggaagcttctacccgctcttggtcttctttctccaccccagtgccaaagaactaagcactgatggagaaaaagcatgcggctaatactgtctgtctctaccacaaatctcataatttttaaaatccatttggaatttacattcactccttaacttcttttcattcactcctaattcacttcctatataattctctacacagctgctgaaaaccttcctttctgctgcctcttaccccaaaactactctcacattactcacaaaggttgaccttgttttctatatacttttttagagtaacgaagccataaaatgtaagttctttcaacctggacctcccactcttgggatttctcaatagcttcacctgtattctcccccttcactcttgactcagaggtaaacgctcccttgctcccaaatcctttagcaacgtagggttgataattgctcctttccaaatttaatccctgcatctgcgcccctgagacagacactgccatgatttcccagcttgctgtcttctccctcctgcatctcctccctttctctgtgacggatattttccctgtgcaagagaaatttcttctgccctaaaataaataatccaaaacatctcttgactccacttaagctaacattcaatatctcactttcccttgtattaacaaaagttaattgagtcagtacggtgctacaattctcagacacaacgataaacatgatagagaccatcaacatgccttggcattttgcctgctttctcttcaattacttgcaacttggcttctactgagctccactgaaaaagctttcatgacatgaccacatccaatcccaaagaaactgtccccttgcccagtggtcttcaaaaccctccaactccacagtgtctcattaactccaactcatttcctactaaacatctcttctcagctcttcaaagtcaaagattgcgaaccaaatctacagacttctcctctcttctcctttgggtccaactccatccttctccatgaaacttcttattcctagaaatggtgtctgcaccttttaggcttccaggcttgagcctagagtcatctttaactctttccatacccagactcccaagacccagtcagctgtttaggtgtctcctctgtatgcagcacttactgtcattgccctggtccatctcccagagcccacatcttgtcccactgtctgcaaagcctttcctatatgctggatataagtgcaaactccccctaaaatcccattgaagtttttacttttttctatcttctttttttacttctttttatcttcctctactcacacagaagtgctccaattatgaggaccttattttattccctttactgtcaaacacaaagccaacatgccatacgaaaagatagtactgtgcttccttcagtgccactctagcacgcccactccagcacacccttcttgtgcgggtgtatgctcatgtgatactatcacaggcaacacttactatgcaatacgttttccacaatcacaatatttccacaatattgtgatatgagctcattcttcaggccttgacacaagcgcccacaaacctaagagaatgcattttcatttttatgatacacagttttcgactgctccactctggctgccaaggcattcctcctccaaatcacgatgtctatatcaaaagaagaacaatgagggagagctggaggtagcgctaagaaacaacctggtccagctcccaggtctcatagagaacactcagaacacgcttgttagaggtatctgctcctggcctcagcttctcagaagcaattacacatcttctgggtaaacgtggagtgtgcagcacagaataccaaagctgagcttcccattgtacctggttgttgatctcctcgttgacctccctcagctgaatatttcttaagaacagtgttcaattaatccaactatccctggtggctggcaggatgaatcagttatgacttatttcatgtttgtgggtgggtgtatgaagtggtcctcaaaggagatttttgctctctgcagacagtctgcctgtctgtaggtcacttcctgccatttcctttgagtgggaatatgagccagggtgttggaagaaggaagagtccaaaagatgtctcagggaatgtcccatagccattggcctggtctgccctagataacttctgagccaggtcaccctaaagtgctacatgaaaagtcatggattttttttctaacttgttgatctcaaatgtcgtgatttggcatgaatatctagcttcccatgttgcagctatggatttattcttgccaaaatattggggattgggctggagagggaagaaggtacgaagatgcattctgtgttgctcaacaagatctgcatggcctcaaccaatgcgtgtttgaccatatggatatttacaaaccccaccatcaactcaccaaaatgaagagtgtcttagacttattctcacaagacaagagggaacgctgcctctaaggagtctctctgggacacctgggagagatttatttaatggtaaagcaaggaaaggaaaagatgaacagtgacctgcaaatcattaaagagggcgactcgatcataggcaagggcttttattagtgctaaaattccacttcaaagtttgctgattcatggatgctttttgttttgctgtttatgttgtagaaactgatttgattttcatagacaaaataactaggcatttataaccacatataggtatgaaagaaagataaaatgatgcccttagcccagtcagaaatactcttaaccatcaaaatagttccctgaatctaataggccaacaatattccaacaccagaacctttgctaccatagccagaatttttaagactgcaccactgttaagtagaggcaatttttaatacttagggtctaaccacaaggcataaaatgcaaaaaaaattacataatcctgtactttttaataattaaatgaaaatacatagactctaagcaggaaaatatctgagatccttaaaacggtataatcataattgttctacattggtaatatgtgtgatgatatttttctccaaaaaaaattctctaccatttcattctctttaatttcttctagcccgtaaggtctagcaaagaggaatacctgaaaagatgcaaattgtacccctgtgctgttcaatgacagcaaaaattgcagctccccaaccccacctcttatgtcccctgagcaatctgtgatcacttgagggtgaggacagtatattgccccaataaactggctttccaccaagtaccaccaagaaatcaaaacagcttttattttattgtgtcatcatatataagttaatagttcataattagttcaaaatttaaaattatgttctaaaaataaagctttctaagtcaatgtaggcaacgattccaagatccttatagttttcctctcttaaacagagaccattatcatatgatttttttttttttttgagacggaagctcactctgttgcccaggctggagtgcagtggtgcgatctctgctcactgcaagctctgcctcctgggttcacgccattctcctgcctcagcctcccaagtagctgggactagaggcacccgccaccacgcccggctaatttttttttttttttttttttttgcatttttagtaaagaccacgtttgaccgtgttagccaggatggtctcgatctcctgacctcatgatctgccagccttaacctcccaaagtgctgagattacaggcgtgagccaccgtgcctggccagtcatatgatttctaaagagaaactgaacagttatttgtagaaactctgcaaagcatgactttgggacgggcacagtggctcacgcctgtaatcccagcactttgggaggctgaggcgggcagatcacgaggtcgggagatcgagaccatcctggctaacatggtgaaaccccgcctctactaaaaaaatacaaaaaaattagccaggcatggtggtgggcgcctgtagtcccagctacttgggaggctgaggcaggagaatggcgtgaacccaggaggcggagcttgcagtgagccaagatcgcaccaccgcactccagcctgggcaacagagcaagactctgtctcaaaaaacaaaacaaaacaacaaaacaaaacaaaacaaaaaagccatgcccaagcccacccctgaccagtgaaatctccgggattggggcacaggtataatgtttttataaacatcttcctagatgtttcctgcatccagggtgataaatcatcatactaaaggcatcatctgaaggctcctagagtatagagaagttcagaataaggaccccaaactattgcacatcctgacactaactagctgtagctgtgcaccctggacagggagagatctaaacagctagttatcttacttcaccgaaatctacaactaaagatgtctatccacgtgttatagctttggcttccctaatctagatgttcaatctacttttctgcaatttggcaaagtaaaacacacatatacagtaatgcacaatgtcctgattgttggggtttattatttgttttgcatttacgcttcttaggtatgtaacatgccaaagtcatgggagctgagtcttttgaaacagaggcttctttgggtgcaaatattaattttctatgaaaaaaagagaaagtacaaagaaaagaaaaaacagcagtaatacagaaatgaatatcttccttgtctaggacacagtgttttttttaacctagatttctttgaacacagactgacacaaaaattaaatactattgctccattggagaggtgcaaacctggggcggtgagagtgaggggaagcgagtgagattgtcactacactagcttctggggacatggagacagccagtcactgagcccctgccttcccttggccatgcagatgcctctgataggttacacggaaaaattctacctcacagcagcccatggggtggaggaaaaataggaacttagttgcctacattcttcctgcatccccttcctcattggtcagagtcaccctgcatgtctgggttgtcacctgctcccaaggtgaccactccaaaagtcaggttctacgcccggtggtggggtgcttcatccaagtacagaaatgccaagaggatccggaaaccttttgacctggttgctgagtcacaggaaagaagggccagccctcctgggacaggtaacaggctggccctgagctgtggaagccctcacacccagaaggagtcaatctgctggggtggccactgagaccaagcaggagctgagggtcctggagtaatagatggaggcccatgagatgtgttcagacacatagtgtgtttgtcaactgcaatgtgtgtgtgcccccaaaattcatgggtttaaatccttacccccaaggtagcagtatgaggaggaggggcctttggaaggtgactaggtcataaggatggaggtctcatgaattgcattagtacctttacaaaagggaccccagggagattccctcacccttttgtcacagtgtgaagacccagcaagaagatggacatctatgaatcaggaagagagccctcaccagaacccaaccctgctacactctgatctcagacttccagcctttagaactgtgagaaataagtttctgttgtttatatgccactcaatgtatagcactttgttacagcagcccaagctaagacagcctattatgtatgagcaggtggctttgagataattgagaaaacagagactataactacaaccagccagagatgggatcattgcaaatgggactcgggttcacacaaggtttgtgacacacacacaaaaaaacataaggcagataaatcagcaagggtagcagtcaggaattgacagacgattaatggattgaggaaacagaatagataatttaaaagcaaacctttgtacacaaaagaattcaggaggtgataaaagtaacattttcatatcagttggaaagtaagttattcaatagcaacagaacaatcatttattgaggaaaaataactatttctttcctggttcaatcttggggtgttgtatgtttccataaatttatccctttttttctgggttttctaatttttgtgcacagaaatgttttttaatagtctctgaggttttttttttatttctgtgggttcagtggtaatgtcccctttgtcatttctgattatgcttatttggatcttctctcttttttctttatcagtctagctagttgtctatcaatcttatttattctttcaaaaaaccaacttttatttttgttggtcttttgcatggtttttttgtatctcaatttcattcagttcagccccgattttggttatttcttttcttctgctagcagtaagtttggtttgctcttgttttttctagttcctccaggtgtgacattaggctgttaatttaagatctttccaactttttgatatcagtgtttagtgctataaactttcctgttaacattgctttaactgtatcccagagattctggtatggtgtatctttgttttcatttgtttcaaataatttattgatttctgtcttagtttcattgtttacccaaaagtcattcaggagcaggttgttcaatttccatgattttgagagatattcttagcattgattttatttttaccgtgctgtggtctgaaagtacggctagtatgatttcagggttttttttcatttgttgcaaattgttttatagccaagtgcgtagtcaattttgaagtatgtgccacgtgtaggtgaaaagaatgcatattgtgtcgttgttgggtgcagtgttctggagatgtctgttaggtccatttggtcaagtgtcaagtttaggtctcaaatatgttaagttagttttctgccttgatgatctatctaatactgtcagtgagatgttgaaatctcccactattattgtatggttatctaagtctctcactaggtccctaaaacttgatttatgaatctgagtgctccagcattgggtgcatacatatctagaacagttaagtcttcttgttgaattggaccctttatcattatataatgcccttctttgtcttttttgatcattgttggtttaaagtctgaaattgaaacgctgaacagaccaataacgaattacaaaattaaatcagtaatataaagactaccaaccagaaaaagccctagaccagagagattcacaaccaaattctaccagatgtataacaaagagctactaccaatcctactgaaactattacaaaagatttaggaggaaagactcctccttaacctcattttatgaggccagtatcattttgatacagaaacctggcagagacacaataagaaaagaaacttcaggccaatattcatgatgaacagggatttggaaatcctcaacaaaataccagtaaaccaaatccagtaccacatcaaaaagctaatccaccatgattaactacacattattcctgggatgcaaggttggctcaacatatgcagatcaataaatgtgattcatcccataaacagaactaaacacaaaaaccacatgatcatctcaatagctgcagaaaagacttccaataaaattcaacatcctttcatgtttaaaacactgacaaactaggcattgaaagaacatacctcaaaatactaacagccatctatgacaaacccacagcaacactgtactgaacaggaaaagctggaagcattccccatgagaattgaaacaagctaaggatgcccactctcaccactcttagtcaatatagtactggaagtcctagccagagcaatcaagcaagagaaaaaaaaaaaaaagaaacaaaatacatccaaatgggaagagaggaagtcaaactatctctcttcacagaggacgtgatttatgtctggaaaacctcattgtatctgtctaaaaactcctggatctgaaaaacaatttcacaacgttttaggatacaaaatcaatgtacaaaaatcagtagcatttctaaacatcaacaatgtccaagctgagagccatatcaagaatgcaattccattcaaaatagcaacaaaaaaaatacaatacttaagggtacagataactggggagtgaaaatctctatgacaagtattacaaaacaaagatcaaagaaatcagagatgacacaaagaaatggaaaaacattccatgcccatggataggaagaatcaatattgttaaaatggccatacttcccaaagcaacttatagattcaatgctatttctatcatattactaattacattttcacagaattagaaaaaactatttggaaattcatatggaaccacagaagagcctaaatagccaaagcaattctaggaaaccaaaaagctgaagtatcacactacctagcttcaaactatgccataaggccacagtaaccaagacagcatagaactagtacaaaaacagacacataaaccaatggactagattagagaacccagaagtaatgtcacacatctatagtcatctaatcttcaacaaagtagacaaaacaagcaatgtggaaaggattccctattcaataaatagtgcttggataactagctagccatatgcagaagattgaaactagactctttcattttaccatatacaaaaatcaactcaagatggattaaagacttaaatgtaaatcatacaactataaaaacctagaagaaaacctagaacataccattctggacataggccctggcaaagatttcatgacagactccaaaagcaatggcaacaaaaacagaaattgacaaatgggacctaattaaactaaagagcttctgcacagcaaaagaaactatcaatagagtatacagacaatgtacagaataggagaaaatatttgcaaattatgcatccaacaaaggtctaatatgcagaatctataaaaaaaaacttaagcaaattaacaagcaaaaaacaacttctttaaaaaaaatgggccaaaaaaacatgaaaagacacttctcaaaagaagacatgtgtgaccaacaagcatatgaaaaaacgctcaacatcactaatcactagagaaaagcaaaccaaaaccaccatgagatatcatgacacaccagtcagaacggcaattttaaaagtcaaaaaataacacatgttggtgaggctgcagagaaaaaggaacagttatatgctgcgtgtgtgaatgtaaattagttcagacactgtggaaagcagtttggagatttcccaaagaacttaaaatagaactaccattcaacccaataatcccatcactgggtatataaaggaatataaattgttctactgtaaagacacctgcattattcacagcattattcacaatagcaaagacatagaaccaatctagaagtccatcagtggtggactggataaagaaaaaaatgtggtacacaaacattacagaatactacacagccataaaatagaatgaaatcatgtcctttgcagtaacatgaatggagctggaggccattatcctaagggagttaacacaggagcggaaaaccaaataccacatgttttcacttataagtgggagctaaacactgagcacacatggacacaaagaatggaatgatagacaccaggggctgcttgagggtggagggtagacgaagggtgaagattgaaaaactaccaattgggcactatgcttattacatggtttatgaaataatctgcacaccaaactctcatggcatgcaatttacccacgtaacaaacgtacacgtgtacccccgaacctaaaataaaagttagaaaggaaaaaaaaaaaactaaatccctatctcacattatacatctaaaaaatccaaatagattagatttaattaaaaattaaaccataaaacacagaaagaaaatacagatgaatagttatataatttaggatgagaacagcctctgtcaggatgaactaaagaattcacaaaaaaaaatgttaacaaattaaatgacatgttaaaaatctggccaggggtagtggttcacacctgtaatcccagcactttgggatgctgaggcgggcggattacctgaggtcaggagtttgagaccagcctggccaacatagtgaaacctcgtctctactgaaagtacaaaaattatccaggcatggtggcacacgcctgtaatcccagctactcaggaggctgaggcaggagaattgcttgagcccgggagacggaggctgcagtgagctgagatcatgccactgcactccagcctggctgacagagggagactctgtctcaaaaaaaaaaaattaagaaactatatattgaaagactataaaaaatagttttggtttttttctcagtaaaaaaataatatatccattgtcaaaaattttctattttcaatattattatttaatagaaaaatttcaacaatttctggagaaaatatatgaaacacatttgacagagttttaacatccttaacataaaggatgtaacttatatgttacatccttaacataattttctttgttcagttaacaagtttttattgagtatctatattgaaatatgcactatgtctgacactggcaacacatttgaggaaataaagaagaaaaattcaagtccacatggaaaaatggactaaggacatgaaaaagtataaatcatcagtacacttctaataaagttaataatcaaagaaatgcaaataaatgtgacctatcaaggtcttgctatttgtactgtcaaattataaaaatacaataacaaatattggcagatattggggaaacaagtaatgtcatatactggtatgtgcttaaactggtaaaagtcttcagaaaggaaattggaaatatatgtaaaaattttggacagttgcatattctttgttctagaaattctacttatatgattagaacctaaggaagttatcatagatttaatcaaagatagttacaggatattcaacatagccctgtatataacagccaagaatctgaagccaacaaaaaatatttagcttaaaatgtatagaatatacataggatgaaattgcataggtcactaaacagtttctagggacatggaaaaaaaaatgccatattgcagaaatgcaatattttgggatgataaaagggcagtttcaaaaaattgaaaaaatagcagttactatgacctcttttggcaaaaataattatatgtaatattgttcatggaaaaatagactggaaatataacgattaaaatgttaattgtatctgggttggtgagattacatataattattatatataatctttacttttttagattgttgttcacagtgacatcaagatttgtcatgggagaaaaaatgaagaagattattattttgtagtcacccaaggagagaagaagtcacatctctggagataggaggagatagggcatatgagccaatcacatttctgcagccttttgtggatacaaaaggggtgggccaagcctttccaatatcccttttcctccttggtacccagacagactatatttaccagcctcctttgcagccaggtgtggtcatgtgactcattcctggtcaatgaaaggtagatggaagcctggcctaggaaacaggtctacatgcaatcttccattcttctcccacccactggctgaaaagaaaggcttctgaggacacagagtggggggaaggctaggtagaggctggatgggaagaaagcagggttctcttgctcctctcatcagagagctactgaggagacccaccgcacccagacccccatactggactgttacaggagtgagaaataaactttgtttagaccactgaaatttgagagttagagctattagcctaccctgattaacgctggggtagcccctcacatctgcccagcaccctcagcagagcctaacccaatcatccaaggttacccaatagagaactcaggcttccactagagtagccgtcacatagagttactgggtcttccaggttctgccacctccaccgtgttttgtgggactctccactgaactcacaaagcacatgtattcagctactccaaagctatgtgtactcaggaagagaaagttctaaatgtttctgtgaccttgtgccactgatatcatgggttctatccttcagagtgctaagaaaagtgttaaatctccagaatagctttggaaaagtggagaaatttgagactttctctatttttagttgctaatatgcattcctgaaaagtttatttaaagccacaaggaaatatttccatattgaatttcaatattgcaatatactattttagaataaaatggaaagatccaggacatagagcagctgagaagctacacagttggcccctgggcttcactcagacagtgcttctctaggctgcaagtcataagtctttgtgtcacccacttttagaagacatcccccggacttctgggaccaacctgaggtttgtaggaatctctgaggatcaatgatcaaacatatattagcttgaaaaaaaactaatatatgtgtatgtttttttaaaaggttaagtttttaacaatttagacgtcttggcattatactctgagaacgttaaccaatgagaataagagtgacaatttagatgtaaaacctcttaaaggtaaagataaaatcctaaccacatggggaaaaccatgtgttctgtggatgatttccctggatttctcaaaagactcttagaatgttctgggtatgactttgggggcatctgttctatgaagatgggcaccccagcatcacctgcatattaacccttcttcttgctcctaaagatgcagaattagctgagattaggaagatgtacaaagtgttctccctgcacttcaactaatgaacaaaactttttaaaaattacttatgatttggaactattttatcattttatatatcctatggcaactggcattttatatttaattttatcatcttttgctttttttctttgatctaaatcaggatgctaagttttgggggggggtcctacagttttggcagagacctcattctaaaaaagaggtaccagactattaaggcagaatctgctgagggtggccccaaacctggtctggtgaacctcactcaactcatcattgatttcaagggcacagaagaggcaaggagatgacagcaggagaaatggacatgtaccatggagaaaggggaccaaccacaccttctgtccaaactgagatttcccagcctgaaacaggtcaacactggggttagcaagaaactttaaactgaataggagattaaagtaataagaagatgagtactattattggtacaaattatattggtaatagttttaagtttcattctttaagacagggtgaatcacagtcccttctctcaaggtccttgtcagcattctacttttccaaggacattcaaaaatttctcatccaaagtcaaacattagtgtgtgtgcctcaaacaagaaatagttttccatcagtctccaaatctttgaatagtaaatggcaaaagtatggaaatgcaagatggagtggggcttaatgttgccacaacattcctacaatactgggatagtcttccttgggaattactttctttcctatcacgtatcaataaggaaagccaaatgtagaaataaagaaatctccccgatttacttaacacacggaggtgacagttacagcgcaaattgagggaagagtaaatgatttccacaaatgaaccaaaaacacttaaaagccacatttaagagaaatggagtcataaaggcaatatttgtgagcagataaaaaatcagcacagaaaaaggtgagaaatacacaatgtctttcatcaaggtgcaaggaaatgtaaaataacattaaaagtaccaactacataatttgaatataaagagaacaatagcaagaaaggagaggggaagtgatggcgatatggagacacagtctcttttgcatgcacagggcagaaccggtgcctcaggctggagggtgtctgtgagtaccccacaatgaaagcaaaagagcacccagcattgaagccacagaccttgctccatgaatcctagctgatgggctggcacagagagatcaggagcagaacaaggaaatccataggaggatcctcccaaagtacttttttttctggtccaaaaatccttaaatctgtcagaagcaggaggttggagtgggagaattgcagagcctggaacacacctgcctgctgatgacccattctgagggggttctttccacttggcagcaatggacttggtaaaaaaaataatagatccttctccatggatcccatttccctttttttttttttttttttttttgagatggagccccaggcagaattaaagaccaactctgggacccaaatttttagaggacaaaggttgatataatggccagcacgatttagtcatttagatttcaggtctaactaactgatgacagactttaacaaaatcactgaaagaaatttaacgtcaaccttaaataacagtagaggcaggtaatataacaaatagagtcaaaatggtttatctaaaggtctaagcccaagaaacatccaacaataaaattaatctaaaacaaattttttaataatcatttttttttcttgagacagagtttcgctcttgttgcccaggctggagtgccatggcacggtcttggctcactgcaccccctgcctcccgggttcaagtgatttcctgcctcagtctcccaagtagctgggattacaggcatgcgccaccacgcccagctaatttttttgtatttttagtagagatggggtttcaccatgttggtcaggctggcctcgaactcctgacctcaggtgatccacccaccttggtctcccaaagtgctgggattataggcgtgagacaccacacccggcctcatcttttctttaacattacaatttcccatcatggtggcacttgacagtagtgggactgtccaacagcaaatgaccccatctaagcactcaggacagaagccattttaggtcatgaaaattatacagattttgtgagtgaagggcatttagttctgagcagaaagtagtcttgcaaaagggaaatttgcaacaacaacaaaaaaggacaaggagggtgacaatgtcaagcaaatgataaccctgctggagcttcagaaggaaccagctacatccctttcctgcttctacagatgctatggcagccccagaggtgtcccactaggatctcccttcaagaaagaatctagcatgcatctgaacaacctccagctgttcacacctcaggccctgcctcatcccagacagccctgagccaatcactgacacagcagggtactagagcctggtcatttctgcccaacccggggcccctccaaaggcaagctctgctccagacctccccgttgggttggtcaaactatcaaatctgtacctggtctgaggctctccctgcccagtcttgcttcatcctcattttatccttcacaggcacagcccccttccccctccaataaaacactaacattcctaattccgtctcaacatctgcttcccagggaacctaactaacacaatactcctaaaaccaataccagcaaaaagtgactttccaagcccctacatgaagactcattttctggaaaataaaatttaatataattccaattacccatgacgctatttagccatttcaaaggaaatgagaaagcttcccaaattgtggtcctcatggagtgaactgatcatcaaatgttgctgtttacatgagggcacacaataattagggttgtatgtaacatgctactttcagattttcaggtaagtctaaatgcttttaattgatgcaagaataataagtccttcagttgatttatgtcatgcattaatatcaatcaaaaggttttctaacacatactttttaatactataaaatgtggggttttttttaatgtcttttttttcttattcagagccacatttcttcacatggtatgttttacctaacctaagggttatgttgttcgtttgtttttaatttcaggtttgaggaatcaagtaacaggtctttctaaatccttttattggatatatgttagttttccattatcataaaagactgaggaacaggaacagcagcatattgtttaaatgattcacaggtaaaaatatcttctccctcttggtctgttttctttcctgatgtctttgctcattgccaacattgtctattttatatataattcttgcaggacattgtgccctgaaggtgaaattggacaggtaaggagatgacccaacaccccttgtcacacctgcaggctctaggtcacttttgtaacacacaatgaaatgggtaaattctacacaatcctttttttttttttttcaaacaataacagaaagtaaatatttgaactgggggctttttcaaacaacacaagtcagaaaaaattgacttgtttttgactgttactttaggcatatatttttgattaatgacaattaaatgtaaatataaagatattttaaacttgaggttttaaaacaaagaatgcaagaatcacctggttaaagttagatattttgtcagtctcaaagtcagttggctggataataccatatcataaaattttataagactaatttgaaggtccatatgaattggtattattgttcgtttttcaatattgatcttagcagtgtatttacagcatacagcagagttaatgtttaatacaaacaaacaagactttccagaaaatctacaaagaatcactaactaatagccatgcttcagttaaatttgtttactttttaaagtacattctcagaagtaacatgtactctcaattaagtaaaacacaaccagaattttggaatttgatctttaaaataataaaaaaactttctctgctatttacagccttggttaaaatcccaacatctggataccagaatctgagcagcaaaatccacggagacacatgtgcaattttatgcctgcaagctcactattatttagaacgaaaccaacgtagtgcatctacccttgtttcttgctacacagaatgtatccagagtacaaactaatgtagattattataaaactcagtgtgtagatattatatatatatacacatgcatacatacacgcacatatataactaaaacaaaatcttcaaaaataatactttttctttctgtatgtgatgtgccctgatagtttccactttactccatcccatttccttttgttaatactggccttgactcacttagacaaatgggtcatgacctgtagtttggaaaacagggctttccagcctggctttaaagaggctggtcctcaggccagcagaaccagcagcacctgggggtagtttgtggcgcacaatctcaaggcctgccctagacctactgaactaggatctgctcttagcaaggtccccaggtgacttatggatgtattaaagtttgagaagccgtcctcctgcatgcaaaagtacagaatgagtatctgtgatctgaactacatttaaatcgataatgcacctcttaaactgtctttgttcaaagaacttctatcctactgagctcaaggagcaacacagtttctagcaagataggtgcaaagaaaaattcactttcaatttcatcaactgcttcaagaggttgcagggactggctgacctggtatcccagctcctgcaggaccgagagtgtgggaggtgggttgaggggaggtactgaattgactgcaatagatccatgagcatataaaagtgtgcgtgtttgttcttattcctgggagaaaatatatagtattcacctaattttaaaagagttttatggtttaaaaagttaagaagagctactaagccatgaaaagacgaggaggaagcttaaatgcacattactataccagataagaaaatctgaaaaggctacatagtgtatgattccaaccatatgacagtctggaaatggcaaaactatggagatgtaaaaagatcagtggttgtcagggcctaggaggtcgggagggatgaacagacacagctcagtgaatttgaggggcagtgaaactaatctgtatgatattataatggtggatccgtgtcatcacctgtttgtccaaacccacagaacatataacaccaagggtatacggtgtttatattaaagtataaccctaatgagaactctggactttgggtgataatgatgtgttgatgtaggttcagcccttgttacacgtcagccacccatgtgggaaaatgttgatagtggtggaagctatgtatgtataggggcaggaattatatgagaacacttgtggtatatgctcaagtctgttgtgaacctaaaactgctctaaaaaataaagtctgtaggtatctatgaaagcgcagacacatggtccgtgagagcacgtcctctctgctataaattggttgtatggttacaatcatacctagaaaggagagaaaataaagagtaagtgaataccgacatgttcaattctgccccagaatacaacaaagtccctgaatcactcttgtttcattgttgccattgcttattcaattcagtcaactcgtatatgtgaagcatgtgctacatacataacgtataatgcaggatgcaaaaatgattatgtgatcacttcaagtaatttataatctagcaaacatataaaacaggcacacagataatccttacatagtaaatgcctcctttttccccaaaatggcaaggagacaaatagcaaggatccgaggacagagaggcaaaattcagaaggccagaaaggcatggagccagaaatccaattcactcgcgagtaaggtatcgggagagagtggtgtacaacgtgacagggacacctgttgctcccaattgtaatcttttctgattggtttatgcccctttccaattactgtgtccatgctaattatcaactatttttattatcaaccctgcagaggggactaagagaaaaaaaaaaactgctgcaaagtgatgctgtgttcattttgcacagaacccagaaatcctgatgaaggaaactgaattggatgccacaagccttatctcctgtgaatgctgaatgactttgtcggtgggttttacgataagatgtactttcttttatatctattaaacaagctatacagaatactggtaaatacacagaagtaaaaagaagaataaaatagataaaattttctaagttaaaagctaagggaaaaataaaaagaattatcaattgatgtgatcaaagaaaaatgtttatctcatggggtgttggaaaaggaacatcataaaaattaataggtagaataatcatcaaaaacaatctgcacaacaaatattacatagctgaggggaactatcattaaaatataatgtatacaaattgctgagaaactcactacaccttctaaatcatgtcaaaagagttgtttgcatataagctgtctgcacttcttctctctctctctttttttttgttcatattcactgcaaggtggcttttgtccacccatgcaaatcactcatatgaaggtcacaatgatgtccaggtggccaaagcctgtggctaatcctcagtcctcatctcaccgagacagcagtttcttagcccttctcctacctccactggcttctcttctcagctcctctgtagttccccctcctctttccaacctgtatgcattggaggggcccaaagctcaaccctaatgctcttctgcatcttggtccctaggtgatctcacctagtcacccagcctcagatagccttaggcttaggaatcacaaatatatctctcacatgacctctagactcatatcaacctctcaacatcacaatttggatatccaacaggcatctccaactcaacacagccaaaccccacttttgacttcctgctcattgcaactgtcccctcttgcagatgtcccttttagagtaggtggcaccatcatatacccagttacaaacaaaatctttaaagtcatccttgactctcctacactgcatatctaatccatcagcaaatgctgtcttttccaccttcaaagtagatccccagtctgatcatttctcactacctcccctttcgctgcctggtgcctggcaatggcctcctaattggtcttccctgtttcaactcttggtccccctctagactgttccccacacaacagccaacatggttcttttagaacttcaaccaatgtaaattatacttcaagaaagctttaaaaaattcaatcagatcacatctgctatgaaccttccaatggttctcctcccgcagtgtgccaaataaaatggaaatgcccttatccttgcttaacagaagtctacaacacagcctcaccagcatgcctccaactcacatcctgcagctttaacctcactccacgccagcccccagtctccttgccgttacttgaaagtgccaggagagctcctgccaaagggcctttgcacatgctgttccctctctctgcaatactcttccccgtgtgatcatacggctcatgctcccactcccttcgggtctcagcttgaatgtcacctcctccctatgaccttccctaacctttcgtgtaaaattctacctctcccttcctcagtctcttgcttctcctgctttgttctggagaataccaaccagcaccacctgatttgtaactattcccttgagcacattctatctcagccacgggaatggaagcttcatgcaggcggggacatcatctgttcagttcatgctgtagcccagcaattctgaatgattagattgaaattggatccaaaaatatcacaaatgagataacgtaacttgttgataagtgtgtgaagagtatgaagagatgatcaagctcacaagtttccaagtgctaacatctataaaactccattgtcacccatcaaatcagcaaagattaaaaaccacaatagaatgtgataaaatagtgctctcagatacttcctggagaagtatagatgggcagaattgggtgatctggtatcaatgatcattctttcataccaatacaccatgggattttgcgatcagaaggtaaagaagacacagaaggaaaagaaggtgaagattaaaccagcaaaaacccataataagtaggacttcttcctattcattagtaagaaagagttgggtgtccccatgggaaaatgctaatttagtgtcctgaaccactgtaccctccaattcctgcttcccccacaacagtggccccacactgagtcctacaacgaggataatgatcctcaacccccaattgcacagacagggctaagtcagagacagtgatgccaaccttgctgatgtctctaaaacactcaactactgggggctaaccctaagcaaaattattgactccgattcctaagttaatttcctataaggtggaagaagcaacaagtgtcacttctcttctgggctctatgacaccaaatagtggagccgaagagacttgctgatgttttgaaacccaaggccaaataatgctctctaaacccttagaggtgtgactaggatattcacagaagccacgcaaaagacagcagccttcaatgaagaaacaaagaaacaaaaaacatggttccttttataaatatttatcgattatctaaggctaggttaattgttgataactatcaattatctgagcaagatacgcagaaacacttcaggtgcttgaactgcagcatcctgggctccaacccaaacttactggagaagaagctttagataccaggaatctgcattttaaccaactcctcagggaaactgccccagagggggtctaggctaaccatgcgcaacttccacccattctcctgggaagtgattgtgaatctcctccaaacccctcttacacttcctgattaagttggtgccccctactgaatgtcagcctcactgaatcttaacgaggaatcgccagactgggggggggattgtgcagcatgtctggggaacacttcactacttcactaaaccctgctgcacacatgctgaacaccgttccaaaggctacaggaactgagcaccgcattggaatctggccctggagggtgcccagcatggcgaccctgaggggtgcaggaacccagtgagaaggagaaacagaaggtacagtccagctcgagaccacgcacataaagaaatctgtaggcagggtctctattattgtgccatattaaatatcttgatattttaaagcaatattatttttctgattataaaagtactcattgtagaaattttaattgtgccatcatcctgcagaaaaatgaaagtacaaaaaacgaaaaagcagctatacacggccacaaagtcacagggctcatcgggatgtgctaaccaggctggaaactgatcaaagctgatttattgagaaaaaataggcagcatatcaaagacttacatcagcttcatagtagacagactttgggggcgggggaactctgtctcttttgagtatattctcaaaaggataaactttcaccttcctgtgaagcacagttactataaatcagatttgcaaactgtgagaaatgcttacaactcaatgagtcttttgtcagccagtgggggctccatcgtgaaatccacccttcgccatagcgatgggataaatcatcaccagccccgagacatcgcctaatcccttcctcgcaaggcagattcgggcgctttctgcatctgcttcgtgttattgaaaagagctcggctcatctgctgggctctcaggcttcacagtgacctcgcacagaacgctgctacttctgaaactgttttagactcttccgtctatgaaacagacacagagtttaagtttagcgtcttttatggtcagaaatatttagcgttacttccagagcggcagccgtggaacaatgtgggaaagaagtgcttcagttcacttcttgggaagtactgaccctgggtcaatttaattttttccgtaagatttccccttcttacttttctccttccactgctatatgtaacagtatctccccttccactgctatatgtaacagtatctccccttccactgctatatgcaccagtatgctagtatacaacattatagattaataatatgctatattgtttaaaaatattaatgttatataattaacatggtgtgcatattattatattgacaatacgtaatgtgatgtgataataagtctcactgagtgccaggcaccgctttgaatgctctaaactcattagctaatttattcctcgtgattctatggggtagatgcactatttcattcccattttacagctgaggaaactgaggcagctagtaacaggtggagccaagcttcacactgagatcatctggccccagcacactcataaaaatgagcaaaagtataaaagccaaagggaaaaggaagccaaggggtgaaaatcctaattacaaacaaatcctgggtaagctgggtttttagtccttccccacatgtgaacagcaactagaaacctgaacagtgactttgtttcccctgtcatccattgttggtgcctgatcctcacacaaaatcttacggagcagtatctagtgattagcttagctgaattgagcctggacacccttcatgagctggaggacagaggacgtgtcgatggagggtccaacttcaggcatctgtactcgcctgctacaggtgagtggacctatgaacccccagcctcatcaagcacccgagggtcacctgcctgcttcacctggaagagacagcaaggtgtgatcccaggaagatcctctgccaggaggcttacaggcagaagcagcggctgctgaacatagatgctgtcggcaggacacaggggtgatagggggtgagccagtggagcaggtgaaggtgcagactacaggcagcccccctgagatcctgcccagaccccagcagcagctcccctgtccctctctagcagcttcgctgtgcccgaagtgtttgagaacaggtgacccatgccctgagtggcagatgctgtgtctttttgatcccttctctccctccccccccacccccagtggggtacatggaaggtttgctaaatgtttgttgaatgaataaacgagcccaagtcagaagcagtctccaaatcattcctcatcgcaaaagggtgcggtggaaaaactcacaaagccaaggcaggaggacacactcaacttggaaacggcccgtgcccagctttggaacaggcacagcctgagcttcaaggaagtcacttgaccagcagtagctcccacctttccttgcagctagaacagcatcagaccaagtgatctctaatgtgatgatttgctaaagtacaatgagttttacaactagaaagtaccttcctctcaagactgacttcactatgagccacctaatttttcctctctcttcttttggtatttttgttgcaaatagtacacacaaaacaggatatataatctatttgtgcaatttaaagaataagaagcaaacacctttgcaggtactccctagtccacaacagtcagccccaggacctcagaagccccttatgcctttcccctaaaactctcccctccctgacaaggtaattccaatgctgagttatgtggttttttttccttatttttcttttcaacacatattacgtttctctgaataatatgctttttaatgttgcctctttttaatctttatttgtggaatcatattgtatgtaatctgtgacttttttctactcacatatgagaaccatccacactgatacatggctacagatagacacttggagtttatttttcactgctgtatagtactccattggtggagtacaataggtttatgtatccacttttctgtagatggacacttgggttgttctgtttttgctcatacatacctcctggtgctcaggtacaagggaatacagacccagggtgagactgctggatcacaggctaggcacatcttcagctttactaggtaacaccaagccaatacaaaagtgcttgtacaaactcatgctcctgccagcatggaggacccactgtgccacataaaaacatcactgttattaacttgttttatttgcatatgattattttttcccttatccccaaccacttctcaaagcaactagccagcatgtgccacacaggcaagcacccactccaatgtgatctatatggttaggtatgtatgtaccctggaaaaccctgtgatgttgcttgaggagtatataacttttttatgtatgtaagtagcatgtgctacaaagcgcgttctgttttctgtatttttcactccactcagtgttttgtaaaacatgctcatgttgctccataggtatcagagacaggatgatgttttatctttaagatgggtacgccaccctcattttatagatcacagtgatagctcacaattgtttagtactcagtggggtctaaatgtactaactcgtttaatctcccacgaaccctgcaaaacagatgcttccgtttcatataaaatgagaccaaggcacaaagaaactaaggaacttgtacaaaatcaccaagttagtaaacatcagagcaggatttgaattgagccagaatgtgttcttatccacgacatgaaactggataagaatgcaaagctcagagaattttcatgactagcatctctgggattcacagctggcgaccacggagcagaactaatatacagatggttcccctctcagtccagtcctcattccatcggctccaaaatgtgtattattctatatgattagctggtgaacaacaaaggcaattagttagtcctcttcagcaaatgttagtaaatgaaaatattatagagacagaactctttttaggaaatgcaatcatgtgaatttaaaaatgctttatcagaaatagaattaatgacaaaaatatttataggatcctaagaaaatggatttgctattttttttgtcggctgatgataatcatctgggtgcatctttggttgtgacagctccaccccttcagagagttgtatcttcatacacacctaacatgctaagagtagatgtgcatgatatggtagttagtataatttctgtaataaaaaaagtacttggtcatgcctgtaatcccagcattttgggaggctgaggtgggaggattgcttgagcccagagtttgagaccagcctgggcaagatagtgagaccttgtctctacaaaaaaaataaaaattagctgggtgtagcggtgcacacctgtagtcccagctactcaggaggttgaggcaggaagatcgcttgagcctgggaggcagaggctgcagtgagccataatcataccactgcactccagcctgggcaacagagcaagactatgtcttaaaaaaaataaataaaaataaataataaataaaaaatttttaaaaaaggtacctggaacggcctgcaaagaaagggaaatcaaattatgcttcaagacagtcactattatcactgacagagaagcagctaaaataaacagcctgctcattttgtttgtaaatgaattgccacaattcttgcactatttaaatcaagaatattttatattccatagttttcaaccacccctcctttttttattgtttccagctccttaaacatataaaaggataaaagccatttgttctggcagaaaagagtcatcataaattttgcagagtgaatttctctaagatgaaaggaatgttcctctcctccaggacagcctacggacaggactgtgatgacacagagtcttcacgggaatcacacctgcagtgttaagccacttctgtggaaaactcaagtccttctcagataacaaaaacattttagtagcaatgaaccaaaaacaaaatcttccactatatatgttaatacatcaaaaggaaccattcatgtgccatttataagaacttccttccggccaggtgcggtggctcacgcctgtaatcccagcactttgggaggccaaggcaggtggatcacgaggtcaggagattgagaccatcctggctaacacggtgaaaccccgtctctactaaaaaaaaaaaaaaaaatgcaaaaaattagccaggcgtggtggcaggtgcctgtagtcccagctactcaggaggctgaggcaggagaatggcgggaacccaggaggcagaggttgcagcaagccaagatcgcgccactgcactccagcctgggcaacaaagcgagactccatcaaaaaaaaaaaaaaaaaaaaagaacttccttcccagaaatcatagcagcgttcctcagcccaaagccagaagaaacttctcgcacatgaaattttacttcaaaaactcccatatcaggcattttaatgaatcagtggaagaaaattatcctcccaactttgttgtcaagaaccccaatttcatatgcagaaaaaagaattacaaaaataattattcgaattctaattggtgggattttgataggtttataaaggaaataaatatctttaacacaattctacctcgcagccaacatcagctattagcaaccacacttcttattgccagttcatctctccaaacacacagaagccatgtgagttgaaatttattttttaaaaactctcagttatgatttctcaaaattatatttcatatattgacatcaaccaatatgatgatgatattatatattgacattaaccaatacgatcaaccaatatgatgataattgtagggaaaagaaagagagatctgactgttactgtgtctatgtagaaaggaaagacataagagactccattttgaaaaagacctgtactttaaacaattgctttgctgagatgttgttaatttgtagctttgccccaaccactttgccctagccactttgacccaacctggagctcacaaaaacatgtgttgtataaaatcaatgtgtaagggatctagggctgtgcaggacgtgccttgttaacatgtttacaagcagtatacttggtaaaagtcatcgccattctctagcctcaataaaccaggggcacaatgcactgcggaaagccgcagggacctctgcccttgaaagcggggtattgtccaaggtttctcccatgtgatagtctgaaatatggcctcgtgggatgagaaagacctgactgtcccccagcccgacacccgtaaagggtctgtgctgaggtggattagtaaaagaggaaagcctcttgcagttgagatagaggaaggccactgtctcctgtctgcccctgggaactgaatgtctcagtataaaacccaattgtacatttgttcaattctgagatgagagaaaaaccgccctatggtggaaggtgagacatgtttacagcaatgctgctttgttattctttactccgctgagatgtttgggtggagagaaacatacatctggcctatgtgcacatccaggcatagtaccttcccttgaacttaattatgacatagattcttttgctcacatgttttttgctgaccttctccttattatcaccctgctctcctactacattcctttttgctaaaataatgaaaataataatcaattaaaactgagggaactcagaggccggtgccggtgcaggtccttggtatgctgagcgccggtcccctgagcccactgttgtttctctatactttgtctctgtgtcttatttcttttctcagtctctcgtcccacctgactagaaatacccacagttgtggaggggaaggtcaccccttcagataataagataaatcagagccgaaaacatagttcattcctgaaatcaaatatagaacgtttctaccaacacacattttcaaagatggtgttttcaggtttgtatgggattgtttcacctttatgaattagctttttaaaacctgtaatactttcttgctgacttcatcatttccttctggttgcctggaggggtggtgtggaatgctaataaaatgaatttcagttgccgtccctcacaatctgaactatagaagatatttattgtctcaacttccctatgagcttttctttgcatcatgcagcttcatggtcagcagacactaaaaattaaagaaagtctttctcccactttacttgtgtagcacagacacactgatcaaatatgttcccagcacttccgaagaaaccttatcacatccacaagagatttcctacttgcactttttttgataaacacaaccatcatagcccaacaaaacatcacacagaaatcaaattatagtgtccccataagcatctgctcctctatggccttgggcaaaatttagaatcctcgacatccctagagttaccacaatctctgaaagtgaaggagcacccacaaagctcaaggaatgcattgaaactcttattacttccaattccattttcaaaaaaagtaaatgtgtgtgtatgtgagctgcacatggtccagaatgcctcaccaaatgtattgttttaaaatgtgtgtacgtccatgtgtaattgtatgtgtgggattttgaaaggctttttatattttattcaaaaaggtacacttttcaatatcacaaactttgctttcaattataagcccttcccattttcaattaatgttttaggcaaggaatatacattagtaaaaccaaccacaccacttagggaaaatgaattagtatggggaaagtgaagaactggccatgcagtcaattactttggccagcatagatatagttgaactaaccagcacaggtgtagacagcctgtttggataaggtagcttaagccccaattttttctgcagtctttatttttgtcaaatatatgaaaactaccatctcatttcctccctgtagctattacccacatgtatgtgtagtgtcaaaataaatggccagagtcctctcagggacctcccttggcacaagtcgcacttcctcaccctctcacctccagagcctcaggaagtgcaggtcagaaagcagccagggcaggtgtgaggtgatggagcgctgagtgtcggcgagcccagataaaacaacgttccaacatcggaaatccaatcattcacctacttgtctcctgctcgctaaccccaggcaagtataaaggagatggaattataacaggagttagaagaatttggatgtgatttcatatattaactcagcaaaattttttctgaaaaggtccagacagtaaatattttcagctggcaggccatatggtctttgtcgaacctactcaactgtgccattatggagtgaaggcagccacagatgatatagaaatgaatgcatggggctgtgttccaataaagctttctttatggacactgaaatgtaaatttcatgcaatttacatgtgttacgaaatatgcttcttttgatttttcaaccatttaaaaaagtaaaaaccattttcttagctcctgggctgtgttgactgacccctaattaactgatatgtgggctgctatccatgaaaacctaggcacagaggaaggcagagctggcttcccagccaagacgggacttaccttgatatgagctgctgggtccgggacagtctgaatcatgtccttcagtaagccagcccatctaccagctgttcagaacctgacggctagaagacaaaaggaacaacatacataataataaacaactgcatttctgtgttttatgttctagcaggacaggacacaattcaccaatggcaaaagaatcatagctttacattaaacatgtttgcctaaaggcatcctctaggtacgtgtggtccatgaggtgactagataactcacttcccttccattgggaaaatcacttacaatgagcccaagagaaccctagtccgacaggacagaagaatctagctcaagctaacccacatcacatgcagcatccacacatccttccacgtgggcagcatctaatgagggatccattaaaggaagacgtgggactaaaacagggcatacttctctatcatactgagaaaacaggactttgaaatcccaccaaaactcatgcgatctgcacatccttttcagctttgttattaagttcttagtaaacagcacagctaccattcattgagtacttcagcgccagttccttgagcgctaagggctccacacacattttctcatttcattccaaccacgactctgagagctgtcattcccattgtccagctgtggacgtcaagactcataaaggttactgatttgtccaggatcacctggttaataagcgacagaaccaaacttcaaatcagattaggctatctgactccagagcccaaaaaaaatttggtttgacttaattagcaggtatcaacccacattttgaagggacattttaaaacaccgcttaaataaattaaatttaaagatgcctataatccaggaattttccagaaataaatacttcatccaatatattcctttattcaaattataaagcagcatgttctgaccactgtctgtgccctccccttccaccgagccagtctccaacctccctttgctgtcacaggccccagggctgacctctacagatgggctcagcagggtgccttgcctcctggccacctgtcagggttggttgacgtggccccctctggagagcaggggtgagaggagaggggtatctcttcccctcaccttcccaccaccgacacctgccgcccaacctccctgggcgcttggttatggttctgactgcagctggattctagggggacctctcccgtcatggggcccctccttccaggctccagcctccagtacctggtccccagccagtctctggtgctctgcagatctcagccaagccatcagttcttttttggcactaaaaatgccttttttagtttacatttttagaagccatcacttgctttttatcacctgtagttttttgtttgttttctcctttacaatggctctttgcagtaacaaatgcaaaataaaaataaacaatatgattacagaacttgagacattttcgaaggctgtctttcaaatttgctactgagcgcattactgtagtgacaagtgaaagcattcacaggagtcctccccacattcacatctgtcctttctgacctctcacggtacaggcacacccattccaacccaattgcctctcatgaagagcatctacctccagatctgcatgctccacatctgtcttcagtctccctggaggcctcccaagattggcggagcttggctcaccaagaagatgacatgctgggaaccttaggcattttttttctataaccaaatttctaggtcttggaaaatatgtacttccccccacccccacccccaggcctaaagtccctctgggggatgagagttactgaaagtacagagggagtgaagtgcagtcctgaaattgaaccgggaagcagatgaaggtgaccaggctcctggtgctctcgtgggagaagaggctgggagaggatggggcctggctgaaggtttctgggagcataggaatcctcaactccccttatcctaagagcagcaggtgccacaggaaaacaccactctgctcctggggtcattcagcccggaaggggagcgtctgcaagccatcctcacaaagggagggcgtcccactgcacaaccctgctctggggagcacatggctatttccgtatgtctggacattctctctggactagttcactccgcacagttcctccctgcctgcacacacatgctgacgctcacaccagggactgaagctcgtccccctcccctcaaacccaggctgacctgtggctgcctctgacctgcagaacacagcagagggaaggtttcaggagtcccaggctcaggcctttatggaagtgggagcttccccttcctgcctcctgaaaccaagtccccataccctcagcagcacagcacatggcagaggaccgagtgcccagtggggcagccagcaccaacgccaggcccgggagggagttgtcctggacagtccagagaactgactctcagatgaccacggcccctgccgacatcagggaggcagcttccagctgagtccagtcagcccacagaatcatgaccaataataaatgggttgttgtactaagctgctaggatttggggtagtttattacacacacaggtcattgaaacaccctgtaagtgctctagaggcacggagaagatagagggtaaatagcttgtttcactgtcactatggataagtacaaagatggttccaacactcaactcctcctgtacccatgctttttgccacataactttgtgattcttcccattaaagaggtagaattacttcccaacccttatttttgggcggcctatatgatctgcttcagccaacaggcagtagcagaaagacaagtatgacagatcctagctgaagcctcaggaggcaggacatgttcccctttgcttttctgtaactttccaccagcatgggaacatggccagatgcatgcgggaggatgagaggtacctgaggcagagtcacccaccccaatcaccccaccaagactacgtttgatcatcccatagacaaccaaaaccccagacatgggagggaggcaaccagaccagccgctagccaagtccaaccagaatggccaacccacaggctcatggctgaataagtgcttactgcttgaagccactgaaatttggggaatttgttacacagcatttttgtgacaatagattactgacatacactttgcaatgtacaatcagattaccgagatcttcgttaaaatttttctagccagtgataaaaggagactcaaacagggcatttcaaaggaagccacttcatcccaacacagagacataatatttccactcacctacgagacatgatctcaaaccctaatcctgccctcaaaatgggtttggaaactgaaggataaccaagaaacctccaccagaagcctccatgggattcccagagcccttcccaggagcaactgaattctcacttcacatgatgccctgccagcctcccctggattccaaaaatcaaaacatccttggatatccaagaccgcagcaacatcatagaagttacagcagccactcggtctgtaaccaaccaagacataaactaaatgagcaactgtttgagtctcttgtttcttatggggaagttttgagtactcaggttgcatcaagtataaaatgacagggaagggaatagatagagattccagatgcaacacagtcctgatccttgagggatcgagatgggaaacagatctgtttcatacagatatgaagcggtcagtcctgagagcaggcagttagtggaggtgcccagtgaggcgtgtggatatacctagaggaaagagagagctgattcatgcagagacaagagggtgccaccaaggagccttgatgaacaagaagcatgaggactggaggaaagagggtgaaaggcatgaagcagggaacctaagtttctcccagctctgccacattagagaccaagggcgtatgagcttctcacaccgccaccaccagagtgatcacacaccaaagggattcactcagcacgcagcgtgatggcactgccaccctccacaccagctcagcgaaaacccaacggacctaaagaccaggagaataaaagctcaaccaccctcccctgcctcctcaacccacacggatctctgactctttttttttttttgagacggagtctctctctgttgcccaggctggagtgcagtggtacgatctcggctcactgcaacctctgcctcccgggttcacaccattctcctgcctcagcctcccaagtagctgggactacagccgcccaccaccacgcctggctaattttttgtatttttagtagagacgggatttcaccgtgttagccaggatggtatcgatctcctgacctcttgatccacccgcctcggcctcccaaagcactgggattacaggcgtgagccaccacgcccggctaattttttgtatttttagtagagacggggtttcaccgtgtcggccagatggtctcgatctcctgacctcgtgatccacccacgttggcctcccaaagtgctgggattacaggcgtgagccaccacacctggccctctctgactctttttgcagccatttgagtgcctgttcttttttaccatttcagaggtattttatggattttttaaagagtacttctaatttacttttgtgttcctaatggtcatttctcaaatatgtagtagttggtaaccaaacaaactaaaaccatactaaaaatttttagtagttggtgatagtttcatgtcactgtaggaacctttttattttctattttacctgcctttgaacccttgcagaacttcactctatgttgattgaaaatcatttctttaatacttgtttcttgcaataaactcatttgctaaggtatatacttccatatgattttgtgtttcatgacccagctatattttattattgggtatcttaaagaaacaaaaaaggccttaacaataacagaattctacttgtgtcacttctttgtttttgttttcaaaatgccaatgtcttactaaatagaaacaaacttgatttgaattacgtaagctctaaccacataaaaaagatggactggtacccaaggtagaagggaaaataagcattttgtaattatggaggcagtattgcaaaatggttaagagaaggcctaaatatttgcagggctggtgcaagaaaatagatggaagtttgagacccctcgaccctacccctcctctcttctcaaacccaattgtgttctgcgggttaggggatgcatatagtcacgtggacatcccgatccacatggccacactccattcagcaatgctccctgctcatctttcagacccagggaaacacacacaagatcttcccaagaagatgaactccaggaaacaggctggtgcagcccaaaagatgctcagtcaagtttggaaaggcactctgggtgccccagcacctggggcatgtcctggaatggggatgggttcagctggggagggcaggaatggggcctagaaggcataggcaggacgctgggctgggggcagtgctcgatatgagcacagtgcagagccagatgagggatggaaatcagatctgccacttactccttggaaacctataaatgatcactttatcctccaagagccttagttacacatttgcacaatgaggataatattactgtagtataataagaactccatttgcccttgtctctcgtttctggcatggagctcctaaaactctgggaatttcccaagtgatgggagcatcttttgttctaagaaggcagcaggttggtgagtccctagatagcttcaggatgggggctaattgcaagaaagagtgagtcttgattagatgctcagaaccttcagccccatttcccaacctctcaggagaggagaggagctagaaattgagttgatccccagtggccagtgatttaatcaatcctgcctatgtaacaaaatctccataaaataccctgacggggttaggacagcttctgggctggtgagcatattggtatgaagagtgtggtgcaacccaatgctaaagggacagaggcggccaggcgcggtggctcacgcctgtaatcccagcaccttgggaggccgaggagggtggatcacgaggtcaggagatcgagaccatcctggttaacacggtgaaaccccatctctactgaaaatacaaaagattagccgggcgtggtggtggacgcctgtagtcccagctgctcaggaggctgaggcaggagaatggcgtgaacccgggaggaggaggttgcagtgagccgagatcgtgccactgcactccagcctgggcaacagagcgagactccatctcacaaaaaaaaaaaaaaaaaaaaaagggcagaggctcctgtacttggaatccttccagaccttgccctgtgcacctcttcatctggttgttcattcatatgcttaataataaactgtaatcataagagcatagcgttttcctgagttctagcaagttgttgcacctaaaaggggggttgtgggaacccccaatgttgtagccatgtcagacagagtgtaggtaacctggggacccaatacttgtaactggcatctgaagtgaggacggtgttggggagctcagcccttaaacccatgtgctaacttccggtagtcagtgtcagaactgaattgaactgttggacacccagttggtatcagtgttgaatgactggttggtactggcgaagacatgatgtatttggtgttgggaaacatgaataaaaaatttgtaaaacctccaaacgatgttcagcaattcacaaaggtgtcagtgcaagagttggcctgtatctattctaactggtcagtatgcaagttgaaccattgtttgattatctcctctgtctacaccatcaggcttttgtgaggattaaactaaattatgcctcagaaagaaaactctctcaaggctaggcacataatcaacactaaacaagtggtaatcattataattaagaaagtaaaaatatttcaaatggacgattttgatactgtataaaatgttgcaacttttttttttttgagacggagtcttgctctgtcgcccaggctggagcgcagtggcgcaatcttggctcactgcaacctccacctcccgggttccactgattctcctgcctcagcctcccgagcagctgggattacaggcacgtgctaccatggctggctaattaaaatgttgcaactttttaggaaaaataatcctcaataaataaattgctaattttcataagagccctttgtcaactgactaaaaacatccttaatttagaaatgtattttttagttttaagataactagtcattaagtgaaaacattgtaggcaaaatggctctaagcaatttagtattcataggaatgaatccattccttgaaagcattggtcgctgggtgcacttgtcctggatgagcagatattaggcaaatcagtctttcaccagcaaaccctgccataagaactgcacaggcctgattcctgccaagcacaccaggcccctgactggggcagaggcctcccttatggggcaggaagaaggaggcagggagaaacatagggcccatgatttaaggaggctctccctctcaggctcatgcaagtgcaggatcagtacctaaaggggagcaccgcccgaaatcctgtgccccagtcaccttaacccagtccagccctggctcctgcactccaaagctaagcagggaataccagcgggagacagaagacagcatgagaaactgaatgcatctcccacatttatctaaaaataagaaaatggacttcttcagtaggaaatggctcatctttccaaatgaataaaaatacttatagctatgggttgaattgtatcaattctctcccccagttcatgcactggagtactaacccccggtccctcgggatgtgatgatagagaggtagggcctttacagaggcaatcaaattaaagtgaggtcattagtgacctaacccaatgtgactgatccacttacaaaaaaagggacaagatttaaagacagacctgtatagaaggacgatggtgtgaagacacagggaaaagacaaaagaggcctggaacagattttcctcaaagccctcagagggaaccacttgggctgacaccttgatcttggacatccagcctccggaacggtgagatgatgaatttctgttgttttaagctacccagttcatggcagtttgttacaacagcactgggaaaggaaatcacctctatggagggacttacgaaagtcacttaactaatgcagattagaggcctcacagtcagggcatggcctcaagagccacatccattttaattgtaccatttctcactgaactctgaccctggtcaaggcatgtctcaggctccatggactactattccttccactgatcgaccctggcttcattctggcaagggagggactcatacattctgcggcctgcatgagtgtcatgtgagcacccccataaccttgatccctgcggtgcttctccaggggagccctagcattccagctggcctcatgggcatgccttagagagagggagctgaccctctccttcttcaactggattttatttttattttttggcatgttttgtgaatacaaagattcactgcctgggtgtgccccttgaaagaaggtttcaattgcattcaggtgaaataaccacaaaatgactgtaagccaaatgtagtagtatgatagaaaaatggaaatatcgtaaaagcaccagtctgtagacacctagcttctggttcctctggaaaagggagaagagagtagacagtgatggagaaaagaggggctgtgaagactatagaactgagaaggcagtaattctaaaatctccacactgtagggccaggaacaggcagtgctgggcaatggggcatcttatctcagggaagtcaagggtgtcatgtagaaccaacataattcatccaagtacagcaaagaatccagaaatggtctgtggaggtttggaaccatgaaaatcaaataggaaagatacaaaatatttacatatccacattttttaaaaggggtcctgactaggcagcataagattatttgggttctgttcattttacctttagttgcccttggttctgccatcttttttctctgtgagtcatttgtcttgcttttggtcaacacggctttcctcgggtctccaaagatcctggaataacctgaatataagttgaagaatattaaaccttattttgttttcaaatattaataccagggatcaactgtacatgtaccgacaaaacctatttcttaaacattattttaaaatatcctaaaaggggaaagaacttaaatccttccccttaaaaaaagaggggacaacattcctctcctctgagggaagcccagcattatgaagcaaaaatcgggagtgaaagcaaggccaagcctaactggcatgctgaagcacacagatgcttttgcacagaaaatattttgaaaatgttttcttttccttatagcccccagctttggtaataatggcttccctagatcattctgttagcactttctgctgctcagaacagggtagtgggatttagaatttagaaaacatcccgagaactgtaattaagcaattgtcatagtcccagaaaagaaacaacccttttactttgtaaatgctaggaggatctgtattttttaaaatcttagaacactaactagctaaaaagatagaaagaaaaaaatctttcttacaatatgcctgtagcacggctccaaaatccagtccctctctctcttcttttttttttttttttttttttttttagatacaggaatttcttacacaactttccaagtaaaatattcaatccccaaataatatatttagtagaatccttacaacatgagaaattgtaaatggcatctgtttccgttgaaaatatttttaaattagaaaacatcttaagcactgcatcaaatcaatatttgtaatgggcagaattatttctaaatggttccacaggccagttgacattcccactctacttaggaagcccccagccaactccacctgaagtcttcgaaacctatgcatagaggcaaattgcccagatgtcacagaaaagcatttgttgtgatacagaaaataaaacacattactgggggaaaaaaatcagggtactaaaccacgtacataatatcatcccaatattgcacaaagaaaaaaaaataagtggatgaaataaaagagggaaggcaggaaaggaaagaggatgacctgagaaaagttatcaaaatggttaacagtcatggtctttggctttccagtgtgaaataggagttcttattttcctctttttaaaatatttttaaaattatttattttttaaaccaactaataaaagtaatatatatttaccgtgtacaacattatgttttgaaatatatatatatatatatatatatatatatatatatatatatatatatatatatatatacatgttggaatggctaaagtaagctaattaacatctgcattacctcacatacttatttttttgtggtgcgaacacttgaaatctactcttagtgattttcaagaatataatgcattgttattaactacagtcaatagatcataggtctattcaagttcaagtcacagatctcttgaaattactcctcctgtctaactgaaattttgtgtcctttgaccaacatctccccagttcccctacgctcaacatcactaatcatcaaggaaatgcaaatcgaaatcatgatgagtgtcatctcacacctgttagaatggccattatcaaaaagacaagtgttggtggggatgtggaaaaagggaactcttgcccaccgttggtgggaacgtagatcagtacagtcattatggaaaacaggatggaggttcctcaaaaacacaaagatcaattacaaaacaaaatactatatgttttacaaatgtactacaactcaatttggtatgtattacaaatcaaaatactacatgattgctggcaatcccactctggagatagatccaaagaaaatggaaaatgaaatcggtatgtcaaagaggtaccagccctcccaaattcattacagcattattcacaacagacaaggtatggcatcaacctaagtgtccatcaacataaacgcccataaagaaaagtggtgcacatacacaatggaacactattcagcatttagaagagaaatcctgtcatttgtgacaacatgaacaaacctggagaactttatgctaaatgaaataagccaggcacagaaagacacatactgcatcctctcacttatacatagcatctgaaaagttgaactcctatttccttctttatagttttgtgtattttccaaattttctaaaccaaaaatattcatctttataatcaggggagaaaactaaggaataatcattttataatcctaaacatgcttttaaagcatttatttcactgtaatgtattcttttcccatccagtcatacatgggcccaaggagctggccttccctgctcggcagcctgatgttcaaggggatgggggagggggacggtgcagtagatcatgctttgcaaagctgtgcaaatcttttttttttttttttgagacggagtctcgctctgtcgcccaggctggagtgcagtggcacgatcttggctcactgcaacctccgcctcccaggttcacaccattctcctgcctcagcctcccgagtagctgggattacaggcgcccgccaccacacccggctaatttttgtattttagtagagacggggtttcatcgtgttagccaggacggtctcaatctcctgacctcgtgatccacccgcctcggccaaagtgctgggattacaggcgtgagccacggcgcccggccaaagctgtgcaaatcttgagttaataaacatgttccccaaatccaaaagccaatattgactattgcttggttaactgttttgcatggataagtggttaaaggagtatttggtttccaatttctgcaaagggaataaaagttttaaaagcgtgaactaagatttcctatactatgctattctatagtaggtttttatgccaaaacctctactaggctgaaaggataatttgatttatggttgagacattgttgggcctgatttaaagcccagagtcaagcccagagaggattctcttaaatatgtgcaatgggtatttttaaattagcattatggcgttattaatatttcatttatcctgagagcatttacctgacaacgtaaattatgtgtaacacagctgagaagccacaaaggatccaaaaagatgtcacgaagtccacgaagagaagctttgccagagaaaggcacactaccagccgcgtgagctggcctcatcaaagcaaaaaagtcagaaaattatgtaaaccagactcaagaactcaaaaatacagtcgtttgagaacattggtaagagtgcaaactgctcaccccagctcaatcacccctggtccagcaacggcagaaagccaaggtcaaggagtcacatgacctgaagagacaccccccaccaccaccaccaccctccaagccctgcccctggccagtgggacaaaccacatgacccctgggattcagtattcagtcaggttctgtgttctgtatggggaggtagaagaaggcaccagatcatcaggaaatctggactggaaatggccaaagctgaacacatctgagtacctgaagggtaagcttaaggtgtcaaagcagccatggtgaggcagaaagaaccttgagcttggggccccaagtttatgctgacccactagcagccaacaaaacctccctcagcctcagtttgctcatctgaaaactgtgagtaagaggctctgactccagagaggtggtgcaagttcaatgagaaggggttgctgatggtccagatggacagatgcaaagcactgctttctgtttttgtctttgttttgatacaggattctctctgtcatccaggctggtgtgcagtggtgtcaatagctcactgcagcctggaccctccctggctcaagtgatcctcccacctcagccacccaactagctcagactataggaaaaagagtcatgcaccaccatgcctggctaatttttaaaaaaaaaattttggagacatgagatctcactattttgtccaggccaatctcgaactcctggcctcaagcaatcctcctctctcagcctcccaaagtgcttggattagaggggtgagctaccatgcccagcaaaggcattgttaaattcaggaatgaatgaccaccttgttccccaaaacactagacaagagaaccattctctacgcacagatctccctggccaccacgtgtaagcagcagtgaatattccataggtggaactggctactgtgaagaaagaaaactccagaaaagctaccctcactccaagaagtagcctggaccccacgtgcgtgacagcagcctggggagaaggctccactcccaccagcaatgccaaggacagagcagcagcagccgtccatccccacagttatggtgaacacagccacagagcagcctgctttttccatgtatagccacacacaggtggcaatggcagcagacgtaactggctgcccttcctcccttatggaaggaaacataattttgcttgggtgttctgcctgcccccacatgacccacggaggatgaccagccccaacaccagtgtaaatcctatcactgggcaccatctcttctcaccacggattggtttagggaagggcacatgatataattctggtcagtctaacactcggggaagcgagctagaggacttctaggaaaagtgttggctgatgaagaaaggccatagagtagtagtcctgtctgtgtggcacttggaactgtgagagccatcccaggaccatgagaagaggtcacctgaggataaaaccaatgtgctgtggatatctgggggaaaggagggaagtccttgtgtttctacctatggtagggaagagtataaaccaactctgaaggcatctcatggcagggcagctaggcacatcaaatgcattttccttgttaactaaaccattttgaattggggtcatttttgttgttattgttattactggcagcaaaagtatcccatacactctagtagccatgttcaaaaaagtcgctttcagctcttttaccatctgtatccatagtcacgcagacacgctgagtatgctcttcagttctaattttaaaataaaatgatctgctggaaattagctcagctcatagatctccatacttacaacaccgtatctaagaattagtaaataactattaccatgataagtggcctatctcagtctatccacatgttgagtgtccaggtactggaggtggcatggaacctcccctcaataaacaaaggctatgatgagaggttatactttaaattaaattactgagtggaggcataatgtggtgagggtcacaagagaggtaccaaagatgcagcaacagagcagttgatgggcacttagcatttcagtaagtgggaatggggaggagagcaggaaaggtggaggaaatagatgaggagaggaaagaagggaagtgttctccaaggaagcacgctgcagggaaagagtctttcacctgtatgtcccacaaggcacagagtatgaactcagaaatgttgaatgatttgtctctataattaagggatgatttcactgataatgttgtcttcttccatgatctaaattcaacctgcccttcaaatccattcattcatacaattgttcatccatccatccatccatccatccatccatccatgtattcatgtattcattcatctatccatccatgtattcatccatccatcatccatgtattcatccatccatccacccatccatccatgtattcatccatccatctatccatccatccatacgcactgagttccctccatgtgccaagcactgagctaaacactaactagggttgggctttgccaatgagttcagagcctagtgagagagacagagttgtaaagaaaaaaatcacaaatgccaactcccccattgccttgcttgatccttaatgccagagtgtagcttggttgagcatgacaatcagctggagagctttttaaaaacagaaattctgcaatccttcctcttttttctttattggaaagtccaggggtgaaaggggcaaaagagtctaagtgggagttagggaggcagaagaggattgaaggcagtgtctgaaatattttcagactgagaaggaaaaggaaaacagccaagaacacaaggaggagcagtcagagcataaggaggaaactaggaaagatctaagtcatggaagccaaggaaggacattcagtaagatggaaagttcagtgtcgcaactgcagagagattcatgtccaggagaaagtcattcaaccaaccatacgcattgagaacaggtcctggatttggcaacttaaaacctcttgctgtcctctaaaaatgttgtaggagcctgacagcattaagccaaatggctcagtagttaaaaacagggaggatatgcaaagggcaatgtaggctactcatagaagaagttgagcaacaaagttagggagggagtggcagttcaaagaaaagcactaatgccacagggtgcagtggctcatgcatgtaatcccagcactttaagtcaggagttcaagaccagcctggccaacatggtgaaaccttatctctactaaaaatacaaaaattagccgggcatggtggtggacacctgcaatcccagctactcagaaggctgaggcaagagaatcacttgaatccaggaggcagaggttgcagcaagctgagattgcaccactgcactccagcctgggggacagagtgagactcctcaaaacaaaccaaccaacaaacaaacaaaaccaaaaaaacaatgaaaacaaaaatgaaaagcactaactggcttcacccacccaacatttgctgggcacttactgtacttcagaaattactagtagctagggatgcactagtgcacaagactcagccctgccctcaaggcatttacaaaccaatgaaaagaaggtttatcttatttgctcagtctgtttgaaggatgagaaaagcaggtatgtttatagacaggataaagggagccagtggagtagaggagatagagattctagagccagggcacttaaggacgttactgtctggggaagaggtagaggaaatgccatgtttcacagcacaatggtggggtcagttctggcaggaaggtgggaccccactgtctcagaaggggtgtgctgccagatggctaacaacaggctctcacaggaaaactcctgatttgaagcacttggtcatttctatggagtcaatatttccatcatgggcaactgcaaggaacccaggggagtccctgaatgcagagttgggaaaagatgtgctctaacgcatcattgccggctctagcgagttgggaggagccagctctagcacacatgggctccagaagccaaagagagaccaagaagcctggaactgttgataagaaaagagtgttcagaggaaagctgtgaagccagcatagccagctgctctcctaggcgctgagaccctgtgatgagaggagaaaccagggaggcggagttccaaatctggaaaagtggcaggcttgagtgctcttcagttactcccacttgagcaattttgctttctaaacctggttaatagcccaaaatgtgggctgcttattgtcatctcccttcactgtgtgtgtgtgtgtgtgtgtgtgtgtgtgtgtgtgcttttcctatgtaaactgctgcaccactaactctgctatactttagaactcagtaaggcaatccttagactcttatacaattccctaaagggtccccttttactctaagtcacagagaaatgttgaacatttaaacctttaaagtgcagttttgctggaagaaaatttcaagggtctccatgaatcatgtctgagccatgtattggccatgaccgcatacttcttgtcagtcttatttcatttggttgttattgtggtttggtttcatttcatgttgctttggagggtcaacctttctttcattcatgacattcaatcaacctttctccccagtgcgtcttcccattttttatgtgtgtgtcaggagatagaaaaataaacacaggtattaatgtgcctgtgggcaccagtttgtaaagcccaagacgttcttggacccaaggaaactttcagttctttctcagccttgccgttttgcatgtaaagcatttgagctgatctcagagttgaggtggctgccagcttccaccagaacaaaacacacagcagcaaaacagcgccatgtccctcagtgtgggaaccagggtctgcctggggcccccctgtaaaaacgagagatctgaaggaaaacagacagcatttgaaaggcggatgacatcaagaaagtaaaagcaactataaatatgacttctctcctgctttacactgagccttctgttcaagaaaacacatttaccagggattttttccttaagctcaactggaaaaacaaatatttagtcattttacaagagcagacaactgaaaagcaagccacagattaaacaagcattatgtatttctaagaaagttcatcaaacacaatatatctttgagaacacaatcttgaagtctgttttagaggcaaatttgaccttcaaaatgaattttgtctcgatataattacaaggtcaaatcttaaagaagcaaatgcatagacaaccatctttgcaatgagatctgttttatatttgcaaatgaacaatactggacagaaaaaaaatacataattacttctgaggttatatataaaatacccaattggcaattagctaatatcatattagcatctcaatattttagataaagcaaaactcccaagtacaaaataatctataatagaacaaaaatggcaagtcatattaaagagagattacatataagagactttattacaagttatcattttttagataaaatttattctttcagcatcactttgatacttgtaggaggcagatatagtatagagaggcagatagaggtgagaacctttcctaagaaaaatcaagcagcattaaaagcataaagaaaaaagaagaaaaaatatttcagattcccaattcgtatatcacattgttgacaaaaaaaaaattagagaataccaacaggaaaaggtttccttgtgctctttaagggtggggaatttcaaagaaccttgaactcatcatgaaaatagttctatacccatcggctttgccaaaaacactttgggatttcagtgatgggtactgagccaccaggagcaatgaaaccagcttttccatttccactgagttttgactggtttacaaggattgcacaaagatcacctcatttgtactggacacaattgggaaataaaaatttaaaaatcatccttcatatttaaaatagaaatcatgaaccccgccacaaacatgcttccccgacactcaggacctgaggttgacaacatgcctccccgttaacccatgaagcctcataggtatgcactgcatctatatagaattttccatggactccatcatcaaagcatcctttaacaagtatgaactgagcactcaccccatgcacagagctgtggacggggccatatgggacagaaaagttgcaaggtgtgtctctcactcccaaagagcccacatgccttgcaggagaggaaggctgtggacccaggttttgtgatgcagatgaaggggccacatagctgctccagtaagaagaactggaatcatctgaaggagaggaaaatagggcatttcagccttgaatagcagaacccagatcatgaaaaataggaagaacttatatggacgtcagagaggaaggcaatccagacaacaataataacttaggcaaaacagaaatcaaatgcagcttgcagaagactctgtacagggagccaacacagctactttacgtgaggagtcaatgagaccatttaatagaagccccctgtcgaaactgtaaaaatgattttgccatcttggccatctcctgagatggctgagaagggatttgccaagcaaaaaaagagttgaggggttttgcacaatggcctggaacagagaggctggagagaaatcagacaagtctctcaggcagaagttccagaaaaatgaagaagcaggagagcccgaggcaagagggaaatggcaggcacattggttggacgatgagggtttgtgtggatctcaaagggccaagacgtggggagagtctagacttttaggctaggaagtccgaaccttgttgtgaaaatagctgaagattttggagcacctgccgagcaaagtttcccaaagaggctgttgggaagattcatgaggcaggagactacagggagggaaggccagaggcagagaggccagttccaggatggctgccacgatccagcccaaggtaatgaaggtggggaagcctcggaatgcaagagacagggtggagatgagaagacatgtcagagcctggtggccaattaagcagagaaggtgcagggaagagaggagagcaggatggaaagccaggaaatgtgggtctcagtgaagatggggagttctgtttcagccccaagaatgagcatgtgcatccttgaaccccggggcctgtgaggttggtcaatggaagcccgggagctctgctcagtcagggtctaggactggtactcctgctggggccacctcagagcagaagcagggcgggagcggtggaggctggctctgaagtgttctgcccttaaagaacagcaagactttccagaggcagtgtgtagcctttaagatggagactgtgatgaagaatggagagagatggaaagagcttctcagtgacatggggagagggtccgcacctggagggcaaacccttcctggagggcagaacctcgctggccatctggcttcccacacacctgcctggtgaaccaacatatcactagggggttcttttcttgcttgaaatgtcattgagttttcaatttgtagcattcatgaggtgcattatgaggtttattcagcattttttttcttttgctgagaaaggcacaattaagtaccagaattttctttgctggcctagccttctggaatctgaacaggttttgcaatcccaggaccagatcctctctatataaaaattggtgtgggattggggggggggggtctctttttataatagctagaacatcttaatattttgtaaaaaataagctcatcacgaacccagttaacccagcaaggctactgcccttcttctgtgtcgtggtaacagctttcttcagcagtgcaaggtgcaggcagagcctttcatagttttaatcactaggtccatttattgagagagcttgaaaggtgattattcctgttctcatttctcagaaaactgaggcatgtgaagatcacaggtagggtaagcaaatgaacacaaattcaaactcggaattcaaaaccagcctctgtgtattcctgaggaccatactgtctgctaagtgtagagaaaggcacatcctggttcaacagcagagaaagcaaacaggaggcactttctgtgagtcatctccaccacagggccctctcttttgtgatccagcgatacttgttcacagtcaaagcccaggaagagtggaaagattaacctttgtgagccaaaccgtgtgacacttgattacttgacagaactaatccttctgtcctgatgacagaaattcaactacacaggtacatgcaagctaatatctgttgtaatgcctcccagtttctctggagaattccttagtttcctggacatctctgaaatgcaaagttttggcaacgagtctctgaattaacctctgaaaatctcacccagccaagatggccttcttgagaagactgaagaacatggttggtttcaggctgagctggaagtggtttacctcccaggagaggttccccacagtggtgtttaaggcatggggtggaccaacaccaggaagactcagacatcacaccacccaccttcaactcagtcacatccacctacattttctgaaaacaaaaggcagtctccccaaaaagcactgagactcttgtgtaggtaatctgagcagacaccaacttcccagggcttccttttatccaggagagcttggctgttctttttaatggtaatatcttcttcttcctgcagcaccgggctgtggcccactctggagaaaaggaaagatcattgctggcctgccttcccaatttcagacttgccagtctacaattgtgtaaactaattccttaaaatacatctcattatatctatcatccatctgaatctagatgcatacatatgtatatacacatatgtacacagttataaatatggatcaatataatgagatgtatttttaagaaattggtttatctgtctatatatatttacatacatatacatccatacatagatatctcattttatctctatatctatatacatataaacacacgtgtgtgtacatttatgtatggacataaagatgggtgtaataagatttattttaaggaacttgaaatatagagagatatctatatatatctacacacacacacacacacacacacacacgcacacagagaaagagagagagggagaaagatctatctacatccatcctgttggatctttctggagcaccctggctgacactcctgcattgatgagtcattggttgtaggatgtcctgggaacgaggcatgagcttggacagggctgtcatcatcagcaggcacttcccaaagagggctgacagctgaggcatcttccaaccatactcccagcatctgagggaataagtccttccttcctgaagggaacccagacagcacatcacagagcccacaccaactgggcaaattgaatgtgcacagagtaaattaccaaaactgccaataaaactcagaattataaaatcatataatttagaaattataaaatcatataatttagaaattacgtgatgtaattaacatttgcaatccgttgacttaaagtcgattatgtgggaaataactgagagttcgttaataagcacaaaacaatccagcagaaattgacagcattaggtgctcaggttgtgtggaggtcaatctcagcaaaccagagtcactgggctccctagatggagttaaggaaagccctgatcttggaccagccacgtcctttacacatagcaaggactgtaagcccgaccttgctctagcacaggaaggaggagggcttccctctaaaaaccacccattttctcccagaaccccaagactccagtccctgtcaggctgcagaggtgatttccaaccatctgatgccacctgcatcagaatcgctgaggcattcctgggccccatgccccattcctggagtcagcagccggactatgagactggctcagtgaaccccacagacagggtcacaggcatggaagcgcaggcagcagagtgcaggcacagaggctagcagtgaccatccacctggccctgaacaagtccaccttctcagagttttagtttcctaacctggaaaacagggaataatatcatgaaagaaacaccaggcacagcactaatgtatcacaaatgccacataagtaactgagtgcaaaatgggacatttcctgccatcggctgaggctcagaatagcacacagagcacagcagcggtgcactctctaaaaaaggatgcccgcacatccatgcacaactctctaaggagtgacctaaataacaacagcaagtccctgcccctctgccttcccggcctcaagggtatatatgtcagaaactggtcaatgctgagtatacagctcccacagtcgcagaggggagcagggtggatgtgtagagttttctggtttctgcacagtataaatcctcccacaatttcaatcaaccaaaggaggagttgggagacatctgcacaattagctcttgtgcaccggcactgatagaagagaccagagacctggcattccttcagagaaagtttcagaggctgtgcagcacctctctccaccccagggaaagaaaggaaagggggacataggcagggaaatttcacatccatgtgcagatgcaccaacctcaaggccagtgagggaagcttcaaaaaaaccatttaggctgcctccaagggttcccctagggttctgagctaccagggcacaggggctagtgactgccttccaggtagagaagtttgcagaggctgcctggggacaggtaagaaggagaggccatgggggggcacactgagcttccatccatggtgaggtgagagggcctgggtatatccttgtacccagggacccatggcaggtggctggacttgcaggggtgagccagccctgacagaaagaggctggaggtgtaccagggtgaagctaggggaagggtaccatcagcagacacacacagggatgtcaccctgccatggagagctgtggggcaatgtcactgcaagagcccttccgcaccctcccatgcattccatgaacaaggggcagcttttagacctttgcttcacagaggggaatccgacaccaaattatgatgcatggccaagtaaccccattaatagcccttgttgtcctgtcttcctgctccaaccctggagaaccagaggcagaggtcagtggtaaggagaggagtgggtgtgcaagcctctgaggctgggagccggccatggccccagaggcgtttccgatgctaacaccagctccggatgcaaagaatcttgaaacaggacgaacaataggcttttaaaaattcaacttccctggacctctcaatacttggaaattagactgttcactgtatctagaagtgacagggaaagtctggtgcctgaggagactcggaacagggacaggaaggagctatcagacttgaggcatgagtttggaggaagtaaagttgcacctacatcataacctactgagaacagctcattcagaaaacaaagaagcccagtttctcatatgttgggtgggtggccctgccaggtaaacctgtagcaaagccacatggaaataggatagtgtcaaaaccaatcaggccaagagtgagcaacagcccactgggtctctgaaagagctgaggaaacaagaggaggcaaaagaagtgatctataaggcacgaggttggtgacagggccaggaagtttacaagagcgagcatatcagatagacaaacaccaagaggcagaagagtctacagatacaaggagatccaaacctacccgcaatccccacccaaccccgccccggctttggctaccctggggctggcgaaggtattaagtgaaaacacccaggtttgagaatggctgggcatcaaggcagttttgacaacctcagaatcaggaagtatttgcctgcaggccagtagctgggagaaatgtccagctctacgtagatttctgtagctggggtcccattttccttcaaggtgggatgggtaagacagaaaacgtcccctgaaggacaagactcaggacagctccagcctagtgtctcccggtccctgtttgctccacaggagaaagaccctccagagtgcaatgaaggggcccagaggggacagtaaagggaccccatcccatgtggcgactcccatcatggcagaactgtagaatccaacatcacatggacctcattgataacactgaccacacctccttgctcttaagatggataaagggcagggacaaggggctccgttttatttgaccaatagctgcaaaagtaagaaatcgtaataagcatggaatcacagaaccagttgaatgtagaattaaacaattaaggcacatttctggcttaaagatgccaagaggtttttgtttgtattctttatgttttttttggacaaccactaaacacacattcagagcatcttctataagagccacagagacatcccttgagacttcagatgatttcaaaactctgctatcgctccttgaaaaaggcaagcctgggattgcaacctatccatgcatctaaccccccctggaaatctctggctccaagagtctaatggtgatggctgccactattagatttcctttctctctgggcattacaatcaggtttacaaggaagaaacaccacccagggttatcacctccaccagtggacacagagttcaccagcttttattgccgggactgacagatgtcaaggggatcactggattccaggattgacaggatggaacggtcagtaggacgccttcccccaacaactcagatgacagagtccacaacgcggcagccagatcaggcaggaatcccacctaatgtctgaataacaccactgataggaatccccactgaatcccaactgaaggctcagttgtacactgtgggcccaaaatacctacaacgttttacaaaacctaaagaaaaggcagatctctttggtggcaaaggcaatgtggtgagttaactttgaagcaatccaacaccatattattgtcatagacatgctcactaagaaaaaaaaaatcatacagagaaatagaaaaatagagagataaatgaataaatatttattttgaggtttcactgccaaaggctagccagagaaacaggggagatacaaggtgaagattggaatcacaactaaatattgttcctgtataaggagaattttccctgtttgaattcttagattacttgactccccgagtttctcattcctttgacaggcacccatgagtgttacactccaagcactcaccctcctatttccatgtgccagcatttccagtcactatcttgatttaagtagagaggataacagttttctcctacatagtaactttaaaatagtaacagttttctcctagaagcaacttaaaataaatttattgacattaaaaaattttaaatgaggtgtagtcaaagcttaaccagcacttttttaaaggagcatattttactttatttttatttttatttttattttgagatggtgtctccctctgttgcccaggctggagtgcagtggtgtgatctcagctcactgcaacctccacctcccagattcaagcaatccttaaagaagcatatttcataaagaacacttctgagtcacttctgttgtcttcctgagtgctttttacctgctctttgcatgtggcataaactcctgcttctctaatgcatctcagtttttaacttttggctctttcactgcaaacataggaatttttaaaataaagaaaccacagccaggcatggtggctcacgcctgtaatcccagcactttgggaggctgtggcaggtggatcacgaggtcagcagatcaagatcatcctggctaacatggtgaaaccccgtctctactaaaaatacaaaaaaattagctgggcatggcgatgggtgcctgtagtcccagctactaaggaggctgagacagaagaatcccttgaacctgggaggcagaggttgcagtgagccaagattgtgccactgcactccagcctgggtgacagagcgggactctgtctcaaaaataaataaatacataaataaataagtaaaccaaaacagttgtacaaacaccagatattcaaacatcaaatgacttgataaatgtggactttaacggggcaggggataaggaagggaaatgcagcaactggtgcatttacagcaattaatcctccctcatcattaaaaaacactgctccattttgtaaatagcagcacagagcaaccacactggagaagtcatgcttaacaatacattcatttgtgggctttgtgatttttttccctctcaagccattttgaagaaaatctttgaacacgtctcagtggcttgatgcttcacattaagctcctttaagcagctagaagtttcctgaaggaaacacatgagccttttactcctagaacgccaagagctggtggagtcctcaagaaaaaaacgacgattccagtgggaatgaatttccttctgagaagtgaagggcaaaccacattgaaaaagttgagcttcatgcctcaactcagaaagttaacctagccagggtccaggcaagaacaaaatctgccagaaaggcagggtgagctcagacagatttcaagcaggagcacaggcaaggtaatgttcaaaatcctgtccagcccccaggtactatgaatactcaatgacatcaaatggagccagttccaaattgctaaacttgtagctcatagctgggtctcctcaagaacttgtctttagacccctaaagacacctctgccacatgaagagacccgaaacgcagcttacatccagagcaagtcctttgttaatgaaaatgtgaatggcaaagacatcaaggtctctagcagtggccatatttgaacatgttttaggactttcagataaaatccgattaaaacaaacagattggggccaggcacggtggctcacgcctgtaatcccagcattttgggaggccgaggtgggcagatcacaaggtcaagagatcgagaccatcctggtcaacatggtgaaaccctgtctctactaaaaatacaaaaattagctaggcgtggtggtgcgcaccctgtagtcattctttgcagttccttgctctggggctgcatgaaggacttccacctgtgaaaagaagtggcgaatctggggcccatcattggaaatgccagccttctcactgagtctgctattttgcaagaaaaatcaccaacagcattccccttaagtaagtctctcgagatatcacccaaggcagggaatccccaactttgctcttggatcaagaagggcccccgataaggttttcaatcatccttagaaaaataggaggaaagcggaagaacagtactcttaggcgaaattaacataactgaagtcacattcttttgaaactatgtcctcagatttttgggggtggaggttaaagtgtcctttatttgctgaaatgctgatgaaattagagaatagaggttttcctcctttgttaatgccttcacgtattggcatcttgatttcctccttttaaaaaatgtactagttttggccgggcgcggtggctcacgcctgtaatcccagcccttcagggggccgaggcgggcggatcatgaggtcaggagttcgagaccatcctggctaacacggtgaaaccccgtctctactaaaaataaaaaaaaaaaaattagctgggcatggtagcgggcgcctgtggttcccagctattcgggaggctgaggcaggagaatggcgtgaacccgggaggcggagcttgcagtgagccgagatcgcaccactgcactccagcctgggcgacagagcgagactccgtcaaaaaaaaaaaaaaaaaagtactagttttatgtcttaatagcaaatctccattctaaaatgtctacaaaattatgagaattttattatatacatgaaaacatctattatggaataaataggagaaaatgtaaaatattatgtacagtatgattacaataagaaaaaataatacacaaatgtaaaatgaagatagttacacaagggtggtataattgaggcaattttgagtttttaaataattgtttaatgtccttaaagcattactttttaattaaaagaaatttcatgtgaatgttattataacagatttataatagactttttaaattacctaccaaagcataaacatttatctctacagatattacagtatgcctttccaaaaatagtcaaataaatgttagctcttctattaccagtataatgtgtacattgttagtattactgattgtgtcctgtctaagtacgaactcaactggcatatccacattaggtcctgaagaatggcctcagccttactcaaggaccgttctctgataatgtcagcttgaatagaagcaacttaaaaatctccatgcaatttctattagcctcactcatgctgctgcaagatctacaagccatttgctcttgttgggagtgtgaaatgttaaccagaaagtgtacttattatagggcgtattatttcttttcttgcttgcttctttctaactgaagattctgctctcgttccccttaaaacaatcttcagtgtttcctagatgaaatatttttctccatctgtcctctcttccagcttccacacagttgtagacttactctcttgctgaattttcagtttttcctaccaaaataccggctatttttgttctctccttccccacttctgtccactttttaaaccatcaaaaagctatctatactaccccaaatgctttcaacaccaataatacaaaattatattaaaaatgtgatcttggagtggcacagtaaccattgtcacggggtcacaaaaatcactgtttttaaaaaatggtttccctcactgaatgcccatgctgttcctggacttcactagaagtacaataaataatcttcataaagaacagtctgaaatcaccacatggtagactcgcctgagacaatcaggccttattccaattacaagcacgttgaaatgctagagaaaatctaaccaccaccaacatccaccctgcccccaagaaagaatttacatacattacacacatggccaagaacaagagaaagaaaacagaaagccccaaggtccagagtcaaagaaagaaattcagttagcaagtgctagctgaatccacaggaacccatagggatttgggtcacaagtgcaagtcctaagcactgcgggtggggttccaaggcccaagcagggacaaaggacacagcttatgacccaagagaagcaggagagcaaagactggaacctttcctagcaaaagtagctgtgtgcctaaggctacgtgcagcaaaaacagtcatctgtgagaaataaaaaccacatttctgttacttgtatggtgtgttgcagcccagatagatgatagatagatgatagaaagatagatagataatagctagatagataaatgatagatagataatagataaataatagatagatagataggagataggtacgtaggtaaataggtagatgattgatagaagtaggtaggtagataggtaggtaggtactagatacatagatgattgataagtaggtcattagacagatgattgatagatgataaatgataaatgattgataaatgatagagagagagatgatagctaggtagataaatgattgatagaagataggtagataggtagatagatagataaatgattgatggaagacaggaaagtaggtaggtaagtagactgatgactgatagatagtagataggtagatagatgatacacagaagataggcagatagataattgatagaagataggtaggtagataggtgactgatagatgattagatgtatagatagatggttgatagaaagatgatagacagatagatagataaactgattcatgaccaactgattcaacacccctagggctctggcagaagcaaaaataaaactactttatagagacactttcatagcttacattatagagaattcacaaagaaagaacaatcctcactgaagataagctcacaagaaaattttgtaaagtacatgaagaaaaaaaccaaaataagtagattttagtagatgtagtagatacaaaaagattgaggattagcaccccaaacagcatggataaaagatcaaacaaaagcatctataaagttaatttaaaatgactttttaaaaacagaaatttaaaccataataaaaagcagcagagtataaatcaataacagacagagctgaaataactgaagacaaattccagaaataaaaatttaatagactatcttaaaattagttattcaaaaatggtaagagaaattactgaactacctagaaagaaggaaaaacagagatgttaaggagtgtggaggctagcatgagatgtccaagtgaacagtgaaaatgagggataaaaattattcagaagatatatttggagataaataataaccagattttagagaaagaaatgagacttcagatttttttttaaaaaaggagtcctgagcaaaataaacataattaaatccacatctagtcatatcatgataaaacatcaaagacaaagacaaagtattaaaagtgaccagagaatagaataaagattatctacaaaggaaacaacctgatggatacaagatttctcatcagcaacaacagacgccagaagggaataaaataatgccttcaaagtgctgctggaaaataactggcaacctaaaattctacgtcaggcaaaactaacattcaagagtgagtataaattgaagaaatgttgagggaaagaccaaaagattttactacttacagacacttaattaaagagctattagagtatatcttcaataagaagaaaattaaacccagaaaggaaaaaaatgaaattcaaaatacaaaggtaaacaggctgggcgtggtggctcacgcctgtaatcccagcgcctcctgaggcagtcggatcatgaggtcagaagatcgagaccatcctggccaacatggtgaaaccccgtctctactaaaaatacaaaaaattagccgggcatggtggcgggcacctgtagtcccagctactcctgagaggctgaggcaggagaatggcatgaacccgggaggctgagcttgcagtgagcccagattgcgctgcaccactgcactccagcctgggcgacagagccagactccgtctcaaaaaaaaaatacaaaggtaaacaaagacaattatgagtggatatatatgcatcttaaattcaattttaaaagaaaattatgagttgataaatcaagataagcattgatacaattaaagagataatagtaatgattaactttagaaatcattactaaaacaaagcagaactaaagaactaggtaacagtaacctgagagctggaagtaggggagcagagtcagagggccttggatcgtttggaaagtgggtagaaacaatgcttgatgtcagactttgttaggtgagggataattagacaatcgtaagaagagtctaaccagactaaaattagagtgtataacattcccaaaacaggagattgggataggcagcataaataaatttgataaagtcaggaaaaatgaaagtcacaaaataagttgacagtaacaactacaaatatattttgtatatattgtaatttacacaatatataaattaatctcacttgtcaaaacataaatattctcagcctggatgatttttaaaaatccagttatactctgtttatgagagatgtatctaaaccataaataaacagaaaagtttaacatacatttactgaaaaagatatacctgatataacataccaaaaaagaagttcagctatcaacaaaaagaaagctggaatagccactttactatcaggacaagttagactttaggataaaattatttattagggataaagatgagcaaagcttggtaataaggagcaataattcatcaagaagatataaaactccagaagctgtgggcaccaaacaacacagcctcaaaatacatatgcaaaaatcaacagaattataaacagaaatagaaaatccttcattatagagagaggttgtcgctctcacctaaacagctagattaagtagacaagcaattagtacaatgattctcagaggatgctttgtgagacttcacctgttgcctgacatttagtggccaggacctaaagctgagggtttggaggtgtctgggaccccacattctgaattgtctgaaagaaaagtcagacaatttctttcaccctctatgcaccccacatacaggggcaccagaaccagtggggtgggagcaaaggggtgggtacaaacaatggaacagacctcaccctccagattcccacagcccatcccccatgtcttgggaggcggtttagggaggaagaagggtagaatcacgtaagatcttccatgggttttaaaattgcatatatttattgaaagtatacaacaggatgttttgaaatactcatctggatatacatagacacagcacaatgattactacacagtgatactacagtcaaacagattaacatacccatcatctcccattgtcagtgtctttcttggggacaaggggatggtaaaagaacctacaatccatgtaagagattttattagaccagatcagacttttaagtgattaaaggagactggaaagctcttgaatctactccagacagtaacaagggatgtaaaagagagatctgtccaaacgtggatgaaggcaaaggggaagaaaatttgctgaatgcaccacttatacaaagatctgaaaacacaacaatccagctagatctagcaggcattaagggaacctgaaccaaactgaaaatacatactattttcacgcccatgtggaagatttctaaaaacgacatagtaaatcccaaagaaagtatccacaaatttcaaagaatgaagatccacacaacacgctccctcaccacaataactcgacactggaaaaaaacaaaggtatctcaaaaaaaaagacttaaacttaaaaaaataaaaacaattatgaggcaatcaaagaaaattatgaaagaactaaaccaccacaaaaatcagtacgtgaactcaatctacttgtattcatatggataatctcaacaacataaccttgaatgaaaaaaccacttgcaaaaggatatgtatagaataacaccatatgtgcaaaattataaacacatttatagaatacacatgtgtgcaggtgcacatgcatatgtgtgaaatctgtgctgtatacaggcaaagagaaagcagagtcacgtgaacaggaagaaaacacacccatttctggataccaaatggaagaggaagagactgggcaagaaaaggatcaaatgaatcatgcactctgtttgtaagctgtgtttcttcaaaaagactcagaagacaatacaaccaagcattagcgtgtgttgaatttggtcaaaggcgtttttcgttttattatgactggacttttgtatatttcaaataaatagaattaaaggagaaaagttacttaaatgctccaagccatttttaacacggcttctgctcctctgagcacctggctggtgcctttagagtggcgagagatgagaggccacaagggaaggatggagggagattcaggttcacaggttctttgcaatttaacatagcaacgctgcgatcactattcaaacacacagcaagtaatggatggcacttaatatgcacttcggtttcttccactgcccttgtgcaaagtaaggcttcccagaaaacaataagaactaaaatgttttcctgaaacaatgctagattcctaaaagcaatacccaagcttgagccataatgggttcaagggtggtggatgaaacacatcttcaaggttactgttagttcactgccatgcgggcttctatgcaaacggcaacattcaccatccaagaaagtaaagagcccagactcagtctccctcttccacagatcaactgggcccaaatccatccacttctctgcattcagctctttcattagtaaacctgatactagtagtccacgtgcgcgcacgcgcgtgtgtgtgtgtgtgtgtgtgtgtttagcaagaggggcttgaattcctcaaagtctcaatgaaaactcagtgtagactgaagcaggggagattgaactgcaattgtaccagtgcttaaagacaatgaatgtttgatctgagcaatcattctgtgctgtggtgtgagaaaggaaacctacggagtaatacccctccttcctgtgaccacatgggctggactgtgcatcttggccacctctaatgcaatgcaacaccaacccacgctgtgtctctctctgtccttggcgaggtcctacacacaatgcaaggaactgcttcaccgcactggccaaggacaacaagaataggcttgaggggagattgaaaaagaggaagaaagtgtttcacacagaggagaaaagaagttttagattaaaagagccctcatcacttcccatgtgctctcaccataactgccttggagggaagcaatccctgctatccacaaaccagcaggactggcagaaggtggaacacagaggtaatcccttccaggggctcagacccaacacaagggcttcacccttggctcacttcttctcctcgtgccacgcatccaaaccctatgcagaataacacgcatgccctcatcaccgcccacctccccacctccactgcaacgtccctggtccaggccactgtcacccctcaactggattattatgttagcttcccatgttccctgcttcaaaccttgaaactactgtccacaaggcaaccagcaagatctcccgaaaacatccatcagatcacatcactcccgctgctcacaacccgccaatgctgggcttcccatcacacagacccacggcccttagggaacctggcagcaccccttcatcacgtggcccctctttctgtgacctcatctccactcctcccctctctccatctggccgccctgacctccctgctgctcctcaagctcagaaggcaactggcaaggcaactggctgttccatgtgtctggaatgttcttccccagatagctcccggctcccccttcgcctcccacaggccctcactccagtgtcagtctttccatgactgtcactctataaaatcctaacccccaacactctccatttgctgcctctgcctcatttttctctccttagcatttatttccaccacagcaggcctttgctcatttgtcttattgtctgtctgtctcctgcctgaggatggggacattcatctgtttggctccccgctgcatcctcggcacccaggacaggggtgggcacggagtgggcaggcaataggtgtttgttaatggaattctaaaagtaaatgacaaaagagaagggaggtgaaggcagatctttgttttctggtttataaacttagtgctgggcaggaggaaaaaaagcggggggttcatgtgaagctcctttcctgagtcaacatggtgatttaaaataaactaaatttagttggagaccttttaaatcatttttctcaagtcagttatatgtgctctagctcataaataggaggaagaatgcgggtgacattcccaagactgcagcaaatgtcggccaagtgaaaaacacacagaatgtcctgaagatccagcgacgtcctgaatgtgacgcgttccagttcacaaaagaggagtcacaaaatgtttacaaacctttaccatcccattgaaatggaccttcacattttcctcaaaaatagctttctaaaactgttactggtttacattaattttacctttcttctttttttcccctttttctttcttattttagaaataaagtaataggattagctttttgattaaagcatattaataaaattttgacattttatttgatttcaaaacatgttccagtttccatcattatagtgggtcctgtatgccatgtttatgttttgaaaggctgaaattatgtgtgatcaacaaatttattttatatcaagagcatctgtacatattaaatcctaaatgtgtcttgaaaaataccccctcacctttctctatcctgcattttatctgaagcattgtaagtcttcatgaaaaacagaggaaaaaatgaaacacagtaactaactaggaaccattagaattattttctttgacatttcctttttttttttttttttggagacagagtctcgctctgtcacgcaggctggagtgcagtggtgcaatctcggctcactgcaacctccgcctcctgggttcaggcgattctcctgcctcagcctcccaagtagctgggactacaggcgcctgccaccatgcctggctaattttgtatttttagtagagatggggtttcaccgtgttagccagaatggtctcgatctcctgacctcgtgatccacccaccttggcctcccaaagtgctgggattacaggcacaagccaccatgcccggccctttctttgacatttctaagcagtagatatttgcaaaccatgttaacgatctgtagatgtatattactaacaggcggggcccattgaaatcctaactcttctccatttgtttgctgattcttatcagtttaaataaaatgttcactcttaaactacattttaagcaccgcataggaagaaggtgttcatctgaggaagcagtgaacggacatcataaacttagtcaagactgtttagtaaaatcacaaatagaccaagcagtttcactgctgtgagtttaaaaaaagaaatcactgatctttagtcagacatagttttctgaacgaaagttagcacacgcggcccctttccagtctacagttgacatgtgtcttctaagtgactagactatgaaacctctaacactctcatcagagttaattcagagctagtcactaaagcacgccccctgaccacatcgtaactactgtgaaaagcagtccttatagaaatcatgacgttcttttcctttgtttgcagtaggttgttcatcgttttcatgagaacataagggccctctcccaaatagctcagtccccaaaatgcagacatcagcaaatgacagcaggtaacgcctgcagactggtgctcgccgctcactgtgaaggcaagcaggcttctgcctcagttttttccccctttctcctctgatccattccaatcaacaccactgacagtggacagactgctgtccgggtaagagtgagggggacagagggcctgaagttgctccattcgtcctcatcacgatgggtaaagaagggacttcatgtccatgtgcagttagcttccaaaagacaaggaaatctcccacctagaaggggacccccccaataccaaccacaggctgggccccccctcttcagccggcccctgcccaggtcctgctgaccaagcctcctcaggacacaaggtcagttcaggacttcagtggcctcatcccttgcatcccaccttctgagttaaagtctttcagaaatacagcaccatgggcttctagagctgcatggaaccctggagatcatcccactccactcgttgaacagtgggggaagccaaggttcagcaaacgggattcttccctcaggcttcatatgcaatggaagggcaccagctaaaagctaagcgctttgactcagagccaaagaccagggacctttctagcaccttcctcctacatataacttatatgtaggagaaacagttgtttccatgagcccatagaagaaatgtgatgtcaaagtatgggagaacgttggatagcattaatgtctagtcaatacacattctccccttgttcttacaatgaatcccaatgttgttcagggccacaatatcttcaggtacaaattacattcccaggcttccttataagatgtggccatgagagggagttgtggcctaggagatgtatgtagacatctactctgggtttctgggaaatcctgccctgctcttcctcttagggacaccctcctacctcttccatccttgggaccacgcagatgaaaccacctgcaaagttggcaggcagtggctagaaggcgactgggatggatgaatggcttccttgagcagccaccctgggaccatgcagatgaaactacctgcaaaggtggcaggcagtggctagaaggggactgggttggggacgaacggcttccttgagccctggactggtccatgattgctcaagtccaggtctctccttaggcaagacaaacacacatgtggggaggaaggccaatttatctgatcggtgagttgggaagaaaagacacagcatggtcagcgtggcctcagcagggagtccctcctttggggaaatatcctgtcccaaggccaaggtattattctggttggccattggatgagattcctgggacaggctctccctctgggggaagcccaagattgtccggctctactcagcacaaatgtgtaagtgtgtatcagaggtgaagtatcagaagtcttaggtatttaattattattaaggcaaagattacatcactgcctgagatacccaaatcccatcccaagcaatttcctaacaactgatctcataataataacaatcttattatgaaaaggccagtgcaaattgattcttagagacactattattcagtacaacaagaatcagaaagtcaccataaaaccatggatgtccagttaattcctcaccttactaaagcaaataaactgcctttagaattaaactggcaataccagtgctgccctcaaaactcactgctgcctcaccaatagataaaatgtcacatgagatgatataaaataaatggggagatgcggaattacctcactgaataaaatggttatctgaacaaaatgtcatgtgaactgacttgtcatggagcctaaaatttcttgagtcccattcccttaggtgaaggtgggaaggcatctcaaaaaatgcaagcatggggctttgaaaaagtcttcaagtaaaggaggcagtaaagcaaaaagggtagaatcatgagctttcttcagttcagagttagttctggttctggctctgacatgtactagttttgtgacctttttctaattagtagacaccatctcagaggtagctataaagattttgagatgaagtctgtaaagcatctagtatgtagaagcatagaataaatgatagctgacaattattagagtgattattatttagagtgtctggcagtggtgtgctgacaaaagggtttttgaaaaatcatttgtttggggaggaagccctggtttgtactgactgccaatttccatggtgtgaacacttccattacagtcaacttcaagctaccaatgggatgtcactgaatgcagagttgagaagagatgcatacagtcagctctcaggagctgccaagagtcagcaacagcttctctctggttcaggcactgtagtcacacctattgacatggtttggttctgtgtccccacccaaatctcatctcaatttgtaatccccacgtgtcaagggagggacctgtaaaccccacgtgtcaagaaagggaggtgattagatcatgggggcagttcccccatgctgttctcatgatagtaagttctcatgagatcagatgattttatatgtttgacagttcctccttcacacactctcctctctcctgccgccttgtgaagaaggtgcctgcttccccttccaccatgattgtaagtttcctgaggcctccccagccatgcatagctgtgagtcaattaaacctctttcctttataaattacacagtcttgggtatttctttataggagcatgagaatggactaatatacccgtcttgatcattgggattcctctgtgtacggcaaagcacctagtgaatgaatgatttatgaatgatgggttattattaacacacaaagctatttttgtctcaataattttgcatacctttgaactgagactcagaaaaaaatgttttcatgaataagaatagataagagggacattagagcatggactgttgcttatacttgaccatgaacaccgagacagtgccttcccaacacctagcactattccaggtataagatatatggcctgtaaatgacttctggtttggactggactggactgaactggactggactggattggattggattggacaaggatgcagaaagaaactgaccataagtctgctcagaaaacattcaacctctaagagggagggaagtctaccctcccccacctcatttttatcctaagcactgcctggaggaaatgccctccaagtcccatggtggaaaccatctaagatgccccttcgtccatggggcttgctctttattttaaatacagttcagttttgattgctgaaattttcttggagccaagggattccaacaatgctactactcagaacatcaagaaattccctggagattcccaaagtaaataatgtgatataactcttacctacaattaatctatgcatgaaaatatattgagggatatgacatcttctaaaattacctgcctgaatttctagcagagagacctagggagttacatcatatgctgcctctccaaacccaacctctgaatgacctccacgaagggataacataataatgcggctgtgtcttggtaaatgtcatttattccctcatgaattttgacagagatgacatcaagtttcttccaattctaagatttgatggcaccataaatatgacttcaatttttaacaatttaatgaaaaaatccttctggaaagagctgctcatggggaaacacacctcaggcatgaggcacattttcttttccagcccttcctccaaccataacagatccaaaatggacttccaggaggatcctgaaatgagcccatgtgttcagcctctcccttaaccacatggaaagggcaggcggatgacctgcccaaggttgggaattcttcacacactaaagtccatcactgacatttaggagaacattttgtttaataaatgcaaaatgttctttaaaattatatccatgctttcattgtcaagggtcttaatggatgtgtttaaagcataaataaatatagtaggcattctgcttgcttaacctttcttcctcaccccttcatctcttcatataacattcactgaacataaaacaggacaagtcctgaactcatttctattccaagtactaactcaagtcactggaaaggtttctatttcatttagatggtacagagatgtcctgctgtttctgtaccatccccatcccattgttgatatttgatatgtcatgttcatatctgttgtctttgtttcccaaagggtttgtttagagtccactgctgaagaagaactaaatggaatctgtctctgggcaggaaggtagggaaggcctttgttttcccccacagtggcaccgacccagacaacagatgacagaaggaagagaccacaggcaggacaaggccagcctggagcagcacctggcaggacgaggcttaaaagaatgaataaggggtaggcccaagcccacacgtgtcatggagtaccatttacaactttgcccacttgacaatgggaatggggagagcagagccttccagaccatcaacagtaggatcagaaagtagaagagtctggaaaagcaagactaagccagaataatctggaagaatgcagccccagtgagaagttgacagccaagcaaggagcaagaccatcctgttaagaggcactgagtggtgaaaacagccttgtcatgaaacagggcagatgatcatctcggaacgaacaggtgcattcaggaaagataaaaatgaaaacaggaagatcaggatcattaaccggtaaaacaatgcatgcccctaaaataacaactgacaaggataaagtggcacagagtgagaatcacaaagtaacgtggagcagattgactctaatagaccttttctggccccaaaagcaaaaggtttggttggtgacatcttaagacaccttaactataaggtccctaagtggacaagagcaggcaagctctctcatttggcggggaggttgggggggaacaactttaaaacagaacttaacaaaatggctaatactaactccttgagaataggattcttctagagaaaggcaatggtttgtaggtaatgtagccattctgtcaatagcatcagcaacagcactgcctcctttacaacacagacctctcagcatcaccctctgtggggcaggagacagagtgagcagaggttagtcacatccatgtgggttctagctcccctctaccactcactagcagtgtgacattgctcaagtgacaactttgtgcctctgtttcatcaactatcaaatgagaataaaattagacttacccaccagggttgctaggaaaactaagcgttaaagggcagaacccaatcctgaaaatttagcaagtactcaataagtcaaagttagtccctggataaggacctgaaacatgaagtagatgcaattcaaccagggtcatgcaaagccgggttcagtgggaagaccactgagtctgtcagacacctcacattaagccaacagtcattgtgacctaccaccatccacttccctgacttctccaagatggtgtcaatgacacactctacctgtagaccgacttccttccccatgctccagccagtccagatactaagctgaatgtacttcagagcttcagcttcataagtcaatggagtctagaattacagcccacacacctggtatccagagagccagagaagagccttgggcacatatttctccaagacatgggatgtgtttctctgagacatttcctcatcctcctcctctctattcctcttgctccctcccctcatcctcctcctctctattcctcttactccctcccctgtctcttccctcctgctcccccatttaatctcactgtgatcctagcctgcttcactctctggccttgcagctaattaaaactgtggcccttagtcatttatttaaagaccccaaaaaaatggcacaggagatctagcaatcataaaagcatcacttttctgagattctaacagggatagctcaggaggccctacacaatgtattggtgaatctattctatttcagcctaccttgcctgacactgtttatagggccagaatttattaccagccttacggcttcataaattagctagtcagctattgccacacctcagtatactgtcacatctgtgaatttatggcattgtggcttaatgtagcatcattgtcatcactttccagtacctggagcattcattttatcctggaagataattcgtcatggttattatgagaataccaacataaacaaaagaggaagaaaacatgtaggttatggtctaattgcctgaatcaatcccagaagaaaagaagatacttgacaaagtctgcagtctttgaatgaatcttgaatgtgcttagtattattcagactcgaaatgctttgcacacttgaatgggaaagtatgcagtgaaaatcccattgaaacgccacagaacgccagccaagctaaagtgctgcacttggttggaatatctgggctctgactcctccgtaaatcaacatttaaagtgttagatacagagagtccataaatcattattgcatttcttcagcataagctagtgccttcagcaagtgtcttctgctgtttggctctttgttctgatctggtttgatatggctggtgtgggtttggtttggttcgtttgtggggatgaagaggttatgcaacagaaaggcgatgacttattcttttgctcttgctcacatctcccaggacgtaaaaacaatgccaattcaaccctcctactcatgtatgacggccaaacctgacttctggcttctaactgcaaaatccccagcacactctgcaggcccgcagccagctcgtctgcttaggaaggagcaatagtgtaatttgaacatgaccaataaaaaagaacaatggtcttacttacttttacaggttacattgtctcacaggtaaggaatggaatttttaatacatttaaaaatagagattcctaaccaataaaatatccccatcaccaagattttaaggatgccatgagtagctggtattatcaatgacatttgtgtagtgggaaaagcatggattttggagaaagaaagatgcaggcctaaacgtggactctatcattcactattgcccaaggacaggctttctctccaccaggctaaatcaagtttcccagtacacaagtgtggtggggagcagagtggttccgcagcagcaggctggtaaatttagtcctaaaacaagacaggtctaaaaatcttggaaagtagaatctgtttggaagctccttctagacattctgtcaagcacagccttgttcagtaagaaggaccttagacatactttactcatggcttcccagaaaaaaagtgaaggatgatgccatcagttttcagcatttattgagagaactcgaactactggaggatttcaaagatgcttattgggtatccaagtaagacgtcaagtaaaattttggatacaggaatttgagtgtgaagggaagcccaggaatgcaactatctgggagtcatcggtgtaggtgggattggaagccatgggatgggatgagatcacttaggaagcaacagactacccccttctgtgataaataaattccagcagattagtgtagattattgtccccaactcttatgtcctacctcctttcatgcagctccacatgtcatcttgtgacttgtgcttgcctggcagtagagagcgcactttcctctccaggaaccttgggcttggccaggtgtcttgctttgaccagtaaaagtgagcaaaagtgaaagtgtgtccgttccaggtggcaacttgaagaggaatcatgcatttctgcttgccccttgccatctccccgctgccatgagagcagcatgcctcagagagctgctgtcccttcaacctgggacccagaataaaagacacagggacctccattaggcccagctgagtccgacagagctccagggacctgaagtcctctgagtgacaaacaagtggttgctgttacaaattactgagacttttggaggccatcatttgctactgcagcaaaagctgactaatacaaaaataaaacccatctcttctggcagatccccccagaaaggagggttagtctccctcatagatatcaggccaccaagcctaagagagttccagatggctatgcaagttcagcccaaggcaatatacaaaaatgctccgagtttaccactggaatttccagagtctacttagatgctcccctgagtccccactcatgcctttccagcaatgaaaacctgctccgaagaaaaaatggctgacatcgagatgactctgagtacacaaggtgcgaagttacaggagacagaggctctctcggatctccaggtaaacacacgcagctgctcaggaaggcagcctgatccaggagcctgcaggagcctgagtcctacccagatggtcaggtgcagccccagctgtcccaggacatgcacgggaggaaaggtgaccacgtgctgtcagatagcagctcaggcaccactgtgcagtgcacaaccacacaggccttcattcagcaggggactagatttgtactctttttagccaaatgtgggccttctcatgctccacgtgtaaacgtaactcaccaaacagggcccctgctgctttccgggccaagtcagtggagaggactgaaggccggctcacagctaggaaagcagggctctgccgcgccgagggaatgggtcccaggtctctttcaacatcagtaggtaacacacacactcacagcacacaccacacaccacacacactacatgctcatacatatcacacacacacacacaccccccacacatgacatacacaccacaccatacacatacatgccacacacacatgctcatacataccacacacaccacacacacaccacacatcacatacacaccataccacgcacatacacaccacgcacacatgctcatatgtaccacacacaccacacacaatcacacacacacgtcacatacacaccatatcacacacatacacatcacacgtcacatacacaccacacattacatacacaccataccacacacatacacaccacacacaccacatgctcataaataccacaccacacacaccacatgctcatacataccacacacaccacacacacatcacatacacaccataccacaaacacacacaatcacatatacaccacacatacacaccatgtgctcatacattccacacacccacaccacacatactacatgatcatatataccacacacaccatacatacaccacatgctcagccataccacaccacacacacacacacacacacacatcagcacacacacacgtcacacacattttacatacacaccacacacacacaaagcatgcacacaccacacacaccacatacacacaagaccacacacacacatcatacataaaccccacatacacaccacacacattatatatgcaccatacactcacacgcacatcatgcacacacaccacacacatcacatatacatgccacacacacacacattacatacacactaaatacacaccacatgctcataaataacacacatcacacacacacagacaccatgcatacacaccacagagcacacacataacccacacacatcacatactcaacactccacccacacaccacacaccacatacgcaccacacacacacacacacacacactgcacacacaatacacatacacataaaatttgcatgaaataaacataaaggaaatgaacaccaagattcatctctcttgccctgcatattggattgaaacatggagcagactggccaaatttaagatttttataatttacctctgaaatcttcatcaaattcaaaacacaatttcactttttgccccatccggcagtgttgggggttttgccactggaataacacagtatattttccagtcacaccgtacatcagagctcatgtgtgtgttagtttgttgcaggcgtcctggtagcagagcgtgaggtcctagactcagagtgagttcctccctccagaaatgaaacacctaagttgctcagcactgacagcaaacatgtaagtaaggcaaaggttgccaccagcccagcaggggtcgaacttaaaatgaatctgtgcatgtgggccccttgcctttgacccatggggagcatcattccataaataaacaaggcaatacctaacagccattagatttcttcaaggccatctctgcaatttctttgatgaaacaaaattgaagttcataatttcctcccaagctaatgttttacaataatttttttaaagatcccagagttacagtaatcacatatcaaataagaacattcctgagatgttttccatttggaatagtgaaattatttattaaagcatctcggccttcatccttcaggctatatgtgaagccttcaagaaaacctcctcgtgagcctaaccacatgacttggcagcccccactcctactttctagatcatccctggccatgctccaccacccatcccatgatccagcctcggcaaagccctggctgtctccacattacaccaagcacctggctgcatgctctggcatacgccacttaaactctcctccctgggaacatcacatactggggcctgtcgggggtgggtgggggacaaggggagggagagcattaggacaaatacctaatgcatgcagggcttaaaaccgagatgacggggtgataggtacagcaaaccaccatggcacatgtatacctatgtaacaaacctgcacattctgcacatgcatcccagaacttaaagtaaaacaaaaaataaaaaaactctcctccctactcatcccggcgaactcctgcctgccccttagacacagttcatgcaccagctctgctgggagacaccccttctgtggtctccatagagctcctgtccacctccgttcacagcgtagggctgggaaaaaggttctgtgatgggacgacctggatttgaatctcagcaccgctcactggctatatgaccttggacacttaaccttcctgtatctcaatgttcttgtctgtaaaactgggataatataagcactcacttgaggcaaatgtggtagggaatagatattttaataaatgtaaagcacctagaataatacttgaaacatcacagcccttatcacaatgtattaaagttttctgtttatgtggctatctcccccactagactataagcattttaaaaagaatatgccttattattttaatatccccagtatttagcaaataacctggcacatagaaaattttttgttcagaatgttgaatgaatgaataaatgtatgaaattaaaaatatatattaatattaaattcctgctatcctgtcccaaaagacaatgtgctgtcatcactgcttgaggaagaagtacattatttcacacatcaacccaccttcatcctttgagaatttttttttagagcagaaatagactctatccaaaccatatggcataaagctgtagtttttaaagataaaggtacacttcaaaaaagtgctgactcatttcatccttagatacagaatactcatcttcagcattacaggcttgtgatggaagaatacaaaattttaaaaatatataaattcacctcttagaggtaaaggtttgaagaacagagttatttggtctacttgcaccattagtttgtttttttttaattttactttaaattttgggatacatgtgcagaacacgcaggtttgttaaacaggtattcattgtaccattagtttttaagaatccttgatctttaaaatgctacccacttggcctcctcttttattcatggccttgttctccaggagagaggctgaaacatcccttagggaacattttctgtcaaggtgctagaccaggagtgtgaagcagcgagccttaaattgcaggaagccacaacagcagaaggcagaacgctcctcaaacttgaacgcagagcctggtgctgcttccaggaagtcccaagccagcctgacttctgacagttgatctcaagatctcaacctatattcattttcacatcaagactttatttttgaacaggttccaggatacaacaccagcttttttattgaaggcaaagcattctcaattacttagatacttactaattaatatgattggcgatatggtgcgtatttagaataatctgagatgaaactcattgaagcagctttaaaaagcccattacaataaaaataatacttgaagctctttttttttttttttttttttttttgagaccaagcctcactctgttgcccaggctggagtgcagtggcgtgatctcggctcactacaacctctgcctcccagttcaagcgattctcctgcctcaaactcctgagtagctgggcctacaggcgcctgctaccatttccagctaatttttgtatttttagtagagacagggtttcactatgttggccaggctggtctcaaactcctgacctcaggtgatccagtcaccttggtctcccaaagtgctgggattacaggcgtgagccacgtttggccaacactcacttttcccaaaatgtcatgataataatattcagtgtggaaggactgaattctgagtcacctgcaaaccatgatacagtctgtagcagtggtactgagtgtaatccatagaccagtgccattttgcaaaatgttgactgaccatgatgagagaagtacggaaagtaagaagggcttgtaaaattttagagcaagttgacatcactgtgacatcagtatgagctcagtgctccagttcctctaaataaggtgccgaccacttcagacactgcagcattactcacatttgggcactcattggtagggccacattacaacatgtgaccttttaaggtcagtttgtcaaggataaatcaaattatatgaaaatctgagaaaagggaagcacttattttcataacttattttcataatctgagaaaagggaagcacgttatgaaaataattaaaatttaattaattaaatgtttatggctttttaaaatttatagtttaacattactggctaaataagggaagtcaaattagtattatgtatttataacctttattgattgattgatggcctctttttggtcagaaaaacatatatcttttttgaatgtgacaatcacagtaaccaaatgatgacaaagaagttgacattgaagaaatgaaagccaaaaaattttgtattcattttacttgaaagtataatccctcatatacaaatttttatagtttatgtagccataaactacagttttgcagccataattgatagcaaagtgctaaaaacactgtaggtcacttgaacaaatgtattggcaaacaaaacaatgaaactatcaaaacttgagtagcatttacataaaaaaattttttaaataccgagaataaaaaaaaatttgcaaaaaagagtattattaaaaagacaacaaaagtagatgttgaatatttcatgtctaaaaatgaatgtcttaaggcttcctgtaaagcagcacttacattactaaaaccaaaaacaaacaaaatgaacaatcaaacaaaaatcataaaattgccaagacattaatgtaaaactacattaaagaagtctacttggaaatgttcggtgaatctgtaacccaaaaaaaggaagcttgagtaccactttttaataatatcacaaatcagtgtttttaagaatgggctgatagcatagctgtaatgacaggaaaatactgtgaaatcattattcagataacaatgaaaataaatcaacaacctgcttcttttcttcagaaagtcttgccaggaggaaaaaaaaaatcagctgaacaacatgcttagagacatagtatataaaaactaatgcattaaattcaaggtttttacatttattatgtgatattatagaagatgaacataaagaaccgtagaagcatgcaaggcttgatggctgttatggggaaagattctgacaagaatgtttgaaatgggaaatgaactcttagcgttctggtaggaaacgagttttgtcccatgtttttaaagatgtgaattagacagccagactttcttatctgtctgacatcctcagtatttgaaaatatcttaatactcctatgcaagaaagggatgtggtaattttttgatgtatatctttatataaccatgcatagaagagtctgggaatatacaaaacaaaataataagagtggctaactctggagagaaatgacaaggagttttctcttcttttttttttttttgtgaaacagggttttgctctgtcatccaggttggagtctggagtgcagtggtgtgatcttggctcactgcagccccaacctcctgggctcatgcacacctcccacctcagcctcctgagtagctggggctacaggtgcatgccaccacagctggctaattgttgtatatttttgtagagacagggttttgcgatgttgcccaggctagtctcaaattcctgagctcacagaatccactcgcctcagcctctcagagtgctggaatcagaggtgtgagccaccatacacagcctgctttttctttcttttgcttctctgtatttatagttgtttttctaccctgaatgctgcctatgtcattagaaacaaagaccacagagtcataaaagggtcacacaagttcaaccatttaaaaaacattgtcaagagctttgcccatctaagggaccacatgagcattaatgactgatgggctccatacactacccagaatgactaacacatcaatgaaagacatgatgatctaaggaccgagggaggggtcgatctaaaacacaaaatgtccctgctcaatagccacctgcacacccacagctactgcgtggagaaaagagagagctggctgcagtccccctcctgggggaaactgtgaagcacaacagagacctgctgtctggaacctggtggctccctccccacagtgagcataccacacctgcactctcatgcccccacttctctcatggaacttccctgtcccttccctccagaagctacaagctctcagaatcacacctttcgtgctccagagtcaacaaggctgagtttgtggtgggcaacaaacagactaaatcttcacaccatttctcattaaaccatccctgttcatgagatctgcattaaaacttttttctcttttgtcaagagataaagcagcagtacacagctttagaggactagggcctccccagtaaccctttcctccaaacctttctaaacaaattatcattatcattggtgccgttatcagtatactagtactgttaaagccaagagatgacctgttttaggcaataacatttacaattcaatagcagagtttcctgcacagactgtactatttacagagtcctgcagcccctggacaagggaacacaggctcccagctgcctgcttgcagagttcccctgtgggaggcagtgagatggaaacacctggatgagaggccaggagacataagctcctccatccctggttctttctccagggaagtaaactaaggcagattgcccattctctctgctcctaaaccagaggcaattttaagtggcttccagcattgatacactaggtctctatgaaaggtgcaaacctttccacactcaatggattctcatcacaaccaaagcagcagggcagtgtattagttaaaatccattttagttgcaagtgacagaagataacattgattttttaaaaacaatggtggcttaaaaacaaacaacccaactcaaaaatgggcaaaggacatgaacagacatttctccaaagaccattctatggccaatgagcacatagaaaaatactcaacatcaatgagataccacttcacactcatgaggatggccagtagaaaaaaaatatatcaagtgttgttgaggatatggagaaattggaacccttgttccatgctggtgggagcatgaaatagtacagctgctgtggaaaacagtatgacagttcttaaaagattaaatatagaattaccatgtgatccagcaattatacttctgggtatatacacaaaagaatcaaaagcaggaattcacacagatacttgtacatcaatgttcataacagtattaatcacaataaacaaaatgtggaaacaacctattcatgatcaacagatgaacaggtaaacaaaatgtagtctatacatacacgggcatattactcagccttaaaaaagaaatgaaattataatccatgttacaaaatggatggcccttgaaaacattatgcaaagtgaagtaagtcagtcacaaaagaacaaatatcatatgactccacttacatgagctacctagattaggtaagttcacagggacagaaaggagaatccaggttaccaggggctatggaaagggggaagggggaattagtgttcaacaggtaaagagttttttgggggatgatgatttttaaagttctggaaatgatgtggtgatgcttgtacaatattgcaaatgtgctcgatacccctgaattatattcttaaaaatagataaatgataaaatttatattatgtatgttttaccacagtagatttcttgttaataatggtggcttaaaccataggaaaacaagcagataggcctggtatgattatcagggacccaggttccatccattcagccacctcaacacagggcttcctctttatgatccaacatggctgctccaactccagtcatcatctcagccatgcaacagggaggtgggaggaggaaggacaagggcactcctctacctggaagttcaaccttcccttgagggatactttctggaagtggcacacagtccttccattctattggtcagaacttggtcacatagttgcacatggcttcaagggaagctgggcaatgttgactttgttctgggcacccatcttttcagctaacattgaggaagaagagacaaacaagtactgaaaacaacaaccaatcctgcataagttgaaaatcaccttgagtgcaaatgttttttagcacaggactgcacacctttatgttttcctaggatcacagtcaaaaagaagaagctttaagaaatggttctgaggactttcttctttgttaagctcactttgcaacataagaggaattcagacctcatagggatgtgagctacatagttattcaccatataccctcaggaagaagtagagctaaactgagaagcactacaaagaaaaaataaatgaagaagaacaaaaatgaagataaagggtcactttcttaatgcctcatcctatgcattttgtagaatttgaaacccctggaatggaaagcataaagctctgacaatctgggctgcattcagccttggcagaaaccaggatgtgaccactggctcattcctaatgtttcaggtgggtaacaaatatttgctttttccggggagttgaccacacaccctcttccaattccttcaactcggactgcatcttgcccttgagaaaaaagatttggcaccttcagaacacaccattccccacacttcatttcccattaaggttgtcttggttaaaaatgttgcgggccaagtacatggtttcacatactcacatggttaagagagagaataggagttctatgagtcacagaaaatttggttgaaaaaaaaaggaatcaggaagaatcagtaacactaaacgcccacacgtctcgtctctttaaagcacattgggggaaattttgcttttagtggtaactgaacattctgttgctgctatatatgtcattttcagcagagatgaaataactaacagcctgggaagatttttatagccttcccgtcctttaagggatggcgtggtcccaattttgacctcccttttactactttcctttcctttggataaaatccatgtaatcctctgtaacactagaacatctctgcattactgtgtgcacacctgatttccgtaccgttttcacccctcattttggcagcaatctatgcataaaggcaaaaagttcccacacccctatcctgacctcttggtagccgtgaccctcatcccagctcaaccctcctggcatctcctctctcctgccaggtttgtggctcaagtcaggaagcacgtcagccctgagacctgcaaaccgaatcccacagacagttctagagggtgtgcttgactttggaaacccagtttaactggcttctgcttgaatcatcactccattaacatcatcattccagaaagtcgttgctcaaggtctaaagcacttgaaaccttcccttatatttaatatttattacccatcttgaaggaacggcatctgaggacatcctcccatcttgtaacatggctcccctaagaagggtataacatagtgattgcaaagcaggactctgtagccaaccatccagatgcaaattctgattccatcacttcgcctgaatataactttggataagctgactaacctttctttgcctctacattcttatctataaaatgggcacagtaaaagtgcatcctcattaaaaaaatggtctacaagcatatgaaaagatgctcaatgtcactaatcatcagaaaaatgcagattgaaaacacaaagagatgtcacctcacacccattaggatgaacactataattttttaaaaattaaaaacaagtgttggtcaggatgtagaggaggtagaacccttatgcactgttgatgggtgatagggtttggatctgtgtctccacccaagtctcaccttgaattgtaataatccccacgtgttgtggagggacccagtgggaggtaattgaatcatgagagcaggtctttcctgtgttgttctcgtgatagtgaataagtctcacgagatttgatagttttataaaggggagttcccctgcacatgctctctctctctcgcctgctgccatgtaagatgtgactttcctcctcctttgccttccaccatgattgtgaggcctccccagccatgtggaaccatgagtcaattaaacctctttcctttataaattacccagtcttgagtatgtctttattggcagcataaaaacagactaatacagtgggattgtaaaatggtgtagcccctctggaaaacagtatggagggtcctcaaaaattaaaaccagaaatgctgtgtggtccagaaatcccacttccgtgtccatatatccaaactaactgagatagatatttgcatacccacattcttggaaggactaatcacaatagccaagaagtagaagcaacccaaatgtccatggatggatgaataaatgaaatttagaatatacataccatggaatattattcagccttaaaaagtaagaaagtcctgtcccatgttacaacatgaatgaaccttgaggacattaagctaagaaataagccagccacaaaaaaaagataaatatggtatgattctagttatataatgtatctaagggagtgaaattcatggaaacagaaaatagaatgggttaccacaggctggagaaagtagggagaggggagttattgtttgctgagtgtagagtttcagatttgcaagatggaaaatttcttcagttttgtttcagaacaatgtgaaaatacttaacactactgaactctacacttaaatatgattaagatggtaactttcatgttatgcatttctttttaccataatagaaaaaaaatcatttaaaaagtgattcttcatagagcttttgtatggattatatcagttcatgtgtgtaaagcatacaacactggatggcacgagcgagcatttctcaaatgtcatcgttatcaacgaattcacataccctgctccatgctatatcagcacacatgaattattttatgtttggttgggtgcctttttatttgtttgtatggagttttgttttcttatttatttttgccttctcaattttctgtgttttctgaggcctgttttagaagctttacacatctattttttaattattccttaccaggatgaaaataaaaagtagaaaataaatgtctgagaaaaccatcatctgcatctccttcaatttcataagatacaatttgaagtgccgaattatttcatttgttttgggttttaaaggtccttctttttactgaatgagagggatgtagattggcagcagttgatatgaaaaaaaaaaaaatcaggttgtttccaaaggcagtgtgatgggctgccctaaagctgctgcctcaaaagaaccataaggttcagatcacaaaatataatggtctcagatttcctagggcctgttctgtatataattctctaagaagaacattgataaaaaataatacgtccacaaaaataaaaccaatatgataactctaaaatacatattgtaggaaatcaggttaaaataagtagttgtattttatctgcaaaagagaagtttaaggaaatactgctttgaaataaatgaagataagtcaaatattcattcatttattcagttctgaaattattcagccactattcactgtaagatttctaggtaccattctaggtgttcctagtccccattatgagcaaaagtcgccacttcactgtgttattcgaggagggaaaagtagatacgatgatggaggcatatttgaggtcgatatgagaaagttcacgctcacaaacacagctgtgcataacgggaatggctattttatgagggagtaagttccctgtccctgggaatatgcaggaggagaaaatgtgagcattaagaatgccaagaagaaacttctaactagaccccaaatatctggtgtagataacaatcaacctctcctccaaccaaaaactcttcgagtccagttttaaggcacatcaagtggagagaacatctgtattctcagggtgacttcaggacagaatgctaagaaaatcttcactactgacttccatgttgcctgcacgaagacccaatattccattgtttttaacacagacctataatgaatctgtaacacttattctattaaaaatagtcagctccctttgcatggatgcagattgatgatccatttttagaatctcaataatgattacaatggcacagcatgtcacctggaaggtatactgtagaatccttgcctacagggtttcactgaagctttgaaaagaacatgaagataactgctaaaacttggaagcaaccaaggttccttatataggtgaatggataaacaaagtgtggcacatcaagacaatggaatattatttagcaatgaaaggaaatgagccgccaaaccacgaaaaaacacggaggaatcctgagtgcatattgctaagggaaaagtcaatatgaaaagcctacatactatatgactccaactacatgatattctagaaaaggagacagtaaaaagatcagtggtttctatgggttagtgaggaggaagagaaggatgaatagggagagcccggggcatttttagggcagtgaaacttttccatatggtactatcatagtaggatctgtttttaacatagacccatactgaatcctttctgaaaaatgtgagcctactataatagtatagcctactgtaatagtaggctcacatttgtcaaaacccataaaacatacaacaccaagagcaggccctaatgtaaactatagactttaggtgataatgatgtgccaacctagatttatcaattgtaacaaatataacacactaaaaagcaaaaacaatcaaactactctgagataccaaaaaacaccagatatatgcataaataaagaaatagtgagtaattcgataaatgaaaaagtaaccaagaggaaacttcacaggcatgattcctttaaggaaacaaagaaataagcataataataataaacttctcatttctaaaatccaaaaactgttacaaaaggattcaatgtgatatttttaaagcacaattattgagcataaaatacaatctggaaggcatataactttgcaataaccttttctgtgtttaggtaaggttgactgcagagttgagagctgggccattgacatttgaggtcatggtggcagcagtccgccactattaccacctatgtccaaacatagctgaccctagcatgactcaggttgaataatattcaggaaatgaggccttgggctagggtcccagctcttgcaatcactagttccacaatttgggggaggtgattcttctaggtctctattttcccatacaagatgatatggtttggctgtgtccccatccaaatctcatattgaattgtagttcccataatctccatgtgtcatgggagggaccagggcaggtaactgaatcatgggggtggtaccctcttgctgttctcaagatagtgagtgagttctcatgagatctaatgattttatctggggcttttccccctattgatcagcatttctccttcctgctgccatgtgaagaaggacatgtttgcttccccttctgccatgattgaaagtttcctgaggcctccccagccatgttggaactgtgagtcaattaaacgtctttccttcataaattacccattctcagttatgtacttataggagcctaagaatgaactaatacacaataaatgcacagaagaggtcagctagcagttttcacacccgtctccaggagaagagaagctaggaggagcaggagggcaaggagggtccggctcccaccaaaagagttcaccctctgggggaagggctacttattgggcttttatgcaaaattttatttgaacaaagaattcctcagctttaaaaatagtggcatctggttccttttccctgaaggtatttactcaagccaaggaatgaagcacctgtgggtgaagagcagatgaaagctggaactataaaagccggagggaagctttttctcatttctaaggagattatcaggaagaatgtactctggcccctggaaacccatccaacctctcctctcccacctgggctggctgcagcagctctgcaggatgtcacccaaaaagctccgttcccaaccctgcggcccacagcctgacaggaaaaagaactctctcaacctggattccggggccctgtactctaatagagggctggacactgcctggctgtccccctgcttagaaggaagcaaatgtttattcaaaaatatttattaggtaatacaacaaactgtcaaaaaggaagaggcgaacactgttacagtttacaaacatgaaccatggattcttaacaaatgggagactttaaatggggatggaaataaagccccaaggaggggaaagatgttgtggaaatgctgcccagtgggaggcaggcttggaaccgcacgctggtctggctggtgataatctagtctagatgaagatctggacagcatccttctgctcagccactagcctctctttgctttctagtcagtgtaaaaagcatctcaaaaccattgctttcccagacttcagtctcctgaaatgtgtgtgtgtgtgtgcatcccatatgtgtgtcattttgtgtttctgccagcctttctgttgaaacttgccagagaaaatgacccacctgcgaattggcaaacggaacctgactgaataaaaactccttgattcagagcttaagaaacaatccagtggatttcttactaatctgggtgttcaaaatagtctttctacttacttgggctcaatattttggaagctattgtggtgaaatgagtgatcacgttggaattagacactgtactactaattgtgtgtccttggaaagttacctaacatttctgagcttccatttcctcaacataaaatgaggataaaaatgtccatcatgcaagattgtcctgacaactgtgctactgtctacaggatcctaagaaagagcaactaaaattatgttaatgttattaattataattttaatcatcaatactgttaataataataaaagactttaaaataatttcctcgtttttaacttactgtaatatcaactgtctgtggtagcctgttcacttgctttgtccttagtcttgtgatccatgtctttttcttatctgttagttttatgctgtctcttcacaagttctttttctgcgtgtgtgtgtgtgtgtgtgtacacatgtgtatgtatgcaagtgtgtgttccaacaggggttcccacttgcccattagaagtttatgctggggtctagataataaaagtaagaaatccaggactacacaaatgttaactgagtggattgaagagcaagagagttctcatcacagccaaacctatgagcacaatgcattgggcatatcagagaaaacgaagatctaaggtaaggtgtgaaacacagcacatgcaactcgaaatgctgaggggaagatctggtaggggggcctggtttgtgaaactcctccgatctgggtgcgccagtccgggtgcaatgtccagctcagccacttgtccccatgggaccttgagcaagtcactccatgattccatgcctcaggttcctgctctgtgagttgggaataacagagcccctcccagtgggttgttgtgaggatttggggagttaatccaggtaaagcccagcacagtcggcattctataagcgtgagcttcatcatgatcatcttatcactttgcgtgcatctggccctcctcacttacaactactgcaccccgtggtagaatgcagcactcatccaacaagacttgcaactcacttcatctctaaaatgtaacaggtccaggtaaaaaagggcagattgaacttgtgggcttacctctagaataatatcactaaaagtagaaattcaaatggacaaagggaagaaagaagagacaacagcctgtggaagatgtttgcaaaatttggaagatggaaagcaaataagagaatggcagttgatgagtgaggggacctccctgccagaggatggggggagtcagtaaagggaaaggcaatttgcaacatacgaccctgagagctttggaaatttgaggtcactcagagggtgggagcagggcaaggaatggggctgaaaacatgagagtgtatgagtgttggagaaaggggaaattcaagtgctccctcctcctcccacatcccctttctgatcccctgcagccaggtaaccatcctgtgcctagcaggtaatttagggttcctctccagagagaaatcagggactccaggctctgcagagtgagggaatgaggcaacatactgaaaagggggaccaagtgaatggcaaggtacctcccccaggatcttccctctacttcaccctcagaaccctgcagccaggctctaacaaccccaccctcattccaccaccctttccacagctgacaacagcagtattctcccccaggagatgctgaccaacccaagagaaagagctacttagacagtcacttatgggtccccaatgacatagtcaggtgctgatacccatcacggcacacacccccagccaacaagccccacctgggcacacagtttcctagtgaattattctgaattatttcctagtgaagagcatccaaggtccaccagacacttgtgaaaaacttccaagcattagaaatgatgaccaaaatctaacaatcacgaagaaaaaatgtggagcaaaaagagatgttttaactttaaaaaaaaaaactatcattaagatcctaaagataagaacaaataatacagccattaaaaaaacagttaaagatgccttgaataaaaaggatcagagaggaggttcaacatctaaataacaagagttccaagaagagaaaacatttaaaaatggaagagaaaattctcaaagaaatcatacagaaaaatttcccacaactgaagaggcccactgagtaccccacataataaaaggaagaagaccctaaacaaggcacatctctgtgacatttcaggacactgagatgaaagagaaaaacctaaaacattcagagaagagaaatgggaaccaggatggcatcccaagcttcttgataacaacaataagagctggtagtctatgaagcatcactttcactttccaaatcgtgagggaaatgtttcttaaagggaatcaaaggcccagccaagccatcaatgtgaagaactacaccaaccatgaggctgacaggataacctggagacaggggacccagcatgaaaaccaacagaatcctagggtgccagagggcagagatgccaggacagccacgcctggaaacagccggttccatctgtgagcacagggctccttaaagcaccctcccccacaacaaaacaataaaaaccctgagagatgaccaaattcattctaacacactgaaaagaggaactggttctgccaaggagtttaagggagtcttattgtaagtacttagaaaaaccaaggcaataaaaaaatcattgaaaatcaatgaaaaatcaattgaaaatcattgaaaatcaatgaaaaatcaattgaaaatcaatgaaaagttattgtttttgaaaaaatcgaacattacagcacactatatgactcagttctaagtaacatttacatagttataataatgttacaaatgcatatcaacttaaccaacattatgatttacctacattggaaggatggagaaacaggagatgggggaagggggcatgagctaaattctcatctaccttaggagaaaattgataatgtctgatatggtttgcctgtgtctccacccaaatctcatcttaaattgtagctcccgtaacttcaacgtgttgtgggagggagccggtgggagatgattgagtcatggggtggtgtctcccacactgttcttgtggcagtgaataagtctcacaagatctgatggttttatgaggggaaacccctttcacttggctctgatctgtcttgcctgccgccatgtaagatgtgcctttcaccttctgccatgattgtgaggcctccccagccacgtggaactgtgagtccactaagcctctttttctttataaactacccagtctcaggtacatctttatcagcggtgtgaaaatggactaatacaaagtccaaatgaaaagctcatgaaaacgcagtgatgtatcaacaaggaggtaaatgacagaagaaacagctaagaggacagcagttacctctaggaaagggggctctctgggaaaatggaaggcagagaactgctatttttcattataagcgcagaaatactatttgacttttacaactatgtattagcatgagaaatataacaactagaatagaacagtgataaaacatgtagaaaatttcacagtgaataaactaacgcatacatagataggcaaccgttttctgagagtcagttgtgaacccagaaaaggcataaaatccagttcttcagagccatcccatgctcattgcatgtaccaccagtttgcttcctcccaaaattcacatgttgaaatcctaaccctcaaggtaatggcattaggagctggggggcctttgggaggtgattaggtgttgaggatggacccttcatgaatgggatcaatgcccttataaaagggaccagagagagctcccttcaccccttctaccatttgaggacacagcaagaagatgccatctatgaaccagaaaatgggccctcaacagacaacaaacctgccagtgccttgacattgaacttcccagcctccagaactatgtgaaataaagtcttgtttatgaccatccagtgtacagtattttgttatagcagcctgaatgaaccaagacactcatcatcagggctgttgcatctgccccttcccaccacagtctcactaaagcaaccggaaagaggcaccaaatacgtccccctttgttatgttagtaacacagtcatgttataatacaaaataaactaagcaatgtcaaacagatcaacataattatttagtatgacataaacctcttccaaatgcacatgcaaattttttcattatttaccttttaaaagccttaaagcttaaagtgaaaattagtgtgaaaaaaaaaacaaatttctgaaaggtaatttgtcagtctatatcaaaagattaaagatacatatctttcatcacacaattccactttcaagagcgtatctcagtctgataaactacagcatggtttgaaacagtaattttcatcttggaggcatgtgagaatactgattcctgggccccaccccaagacagcctgattcaattggcctgggataggacctgggcatctgcattctgcactcaagattgggaattcctggtttataatatagaaaactagaaacagcctgaatactcaacagaagaggactaggtagataaatttataatgacagagacatacgatggaatactagacagtttaaaagtaatgtggcattaaaaatatcattaagcatacctatgaacatgggcagatacttctaatgtgctggtaagtgaacaaaacaggtgccagcacatatatataaaagtgtatatataatatgatcccctttggggaaaaacatgtgtataagagagaaattccactatctggaatgaaatgcattacttttcaatagccattatgtctgagtgcagaaagatttaatttaaatacttttgttcatctgtatgctcacggtaaacaaagtattattgacaccatcttctaaagttcaaaaatgctgttatatatcacttgtaagttttaaacattttagtactgttcatatagatttcacctcacaccccaccctaaatccatatacacagacccactcaaactctcacctgcagattctcagagcacactacatcctgccaagtctccagcgtgaagaacaacttttgcataggtttcatctttcctttgtattaataggtaacaaagtctggctgcctcaaactcagaacatccttgcaacactgttacacccactgatcttccaagttcaccttcacaaatgtgcaagggatgagggggacaaagaccaagtcaccagcaccactcctgatcccccagattccagcccaggtaaaccattcagcatcattggtcaaaggtattgggtcactgaaggaggagaggggtagaaacaaggcattgattcaaatacttccaaaatatgtatgtgttttcccaagcagctgttactccccagcttgaggaaagtgctgagttacagatgatggagtatgaaacactgagagagggcacaccctgtgccttcgcagcaagaatggcagagctacagtggctttggtgttttacttcacccacttttatgcctactcttttcttagcgcccccttcccttactcattgcatcaaagtgatccactgaaaagaattaagtcaactgcagagttccagatagctatcctcaggagttttaaaacttaagatgaaagcagtcagggaattaagactaaatcccgaatatgtaagaaaagggctttcccacgtggcacaatacacgtactgtctgcttcacaggtccagcctggtagcaatcaggcaggataccagagcacgcaggaaatccaaaattaggttttactacctataatggaagatttacgggatggtttaattggtagtctcaggactaaaacctgaagcaggggaacaaaaacgtctatctggacacagccagtgagcccacgtgcaccccatgacactcgctcataggacacacaggcccgaggctgcaggggacagagtaaggtcacaactcctccttctcccaaccttgatgcacaccaaagccaacaacatgctatttcctgttccttttatttaagaggcaaatttgtttcttgtggtagaatgggtcttcaagctacacacacaaactcaggtgttccgcaaaacaaaagaactcattcaattcagtcctcccctgtatttccaaaccacaggggcaacactcacaagctgcaaagaggattccgccccaccgggaatgcatcggtctgcacctgtctgttgccattttcagggttagcagggccactggaaaatttcctcagtaccattttgggtcaatgtaaaggataattgaagtgcatgtttctgtaaattccacgtgctcagagagatttcaagtaaacacaggaaaataagaactgtgggcttgagccatatgttggctggccacgtggggcaggaagaacacacactgtccaggcagtgagtaactgaaaaccaagtgcccacagacaccatccactgccagaacttgggaagctggggtcccaagggacagtcccctctgctcaccctctcccctcctttctttctcaccctctcaacaaactttagtggagttggctttttttcctagaggccttcatagccactttttcccctctccaggtggtagcctgggacctactgtgcagaaggacacacaggtctgaattgaggtcaagccaggaagaggaagaagtgcagagcagggcagccactggcttctgaaatccaatggaagaggcggcaccatttagtagcatgacattctgtctgcaaaccaccatgatgatattgttactaagtagaagaatcccttttaaaagaactttcgatatattataacatactataacaagatgggaagacattttccttttaataaattgattttcttaaaggagatttcaactttccagtgatggacacttttcctggcttccacttgttttctgaaggtttccatttgggtgtgatttcttagcaaacaagagccttcccaaacattgcctgcagacatcttggtctgtagaaacaccttataaggagatcaacgtataacacagtctttttctacctagagaattagcaaagggtgaaatttggtatgacaggggtcttccctggattcctttcaatgtagtccaaggaagaactaacttaggctgaattctattaagacaaggttatcacaatatttacaagattatttatcaggattatatcaattaaatattttgggggaaaaaattgccatacaaaaatcatattaaaattgagccaagcagtgaaacaactctgaaatggcctagaaataacatgtatttgatattcactttttctgaatacagatgtgatcttcatgccatcattgaccccaggtggtaaggatcattaatgtttctagaatcctacactgggcagctgatgcctgtaatcctagcattttgaggggccaaggagggagcatctcttgagcccaggagttagagagcagcctgggcaacacagcgagaccccatctctacaaaaatattttaaaacttagccgggcatggcagcatgcacttgtagtcccagctacttgggaggctgatgtgggaggatcatttgagtgtgggagatggaggctgcagtgagctgtggtcacaccactacactccagcctcagtgacagaatgagactctgtctcagaaaaaaataaacgattttaaaaattttaaacccttaaaaataagtaaataataaattcctacactgttgtacagttaacggccccaattactaagctcaaagggaattacccagaaaaggcaagaaaaacctaagtgtgaactatggctatagagaaacaaatatatggcttgtaatataaataggtttcatatacataagagtgtaggcatacattgcaatgtatcatctcatctgaccctgctaccaaataaaccacaatgtgattttgctactgtggaatccactgtgaaacgagtcatatttcaaagaggtatttttagtgatttttaagggcaagaattcacagacttcagatctgggttccacgtgaccatgacaagcacttggtcagttctgcggcttgggctccaaattcaatgtgtggatcaccactgactcaaactaactctatctgtaagatgattcaaaagagacaatttggaaaaacagaagggaggaaagacttgagaaagagtgagcttttacaactaaacagtatttgcttgaatttaaacaccacttaaaacatagacaacaaagacaaaaagcatcagtgaaaatgtatgtcccttttacattccaaatacaggcccagaaagcaataagcaaaaggcacagctgggctctgtatagccgacttgttgatgtttaatgcaggtaccactctgatctcagcccccagatagaagcatatactctagtgatggcccaggaagacgtcgaccagcacaaagcatcaccacacttcccacattctgagttggatgcaaccattctcttagaaacctagtcttgactgggtgtggtggctcacgcctgtaatcccaacactctgagaggccaaggagggcggatcacttgaggtcaggagttcgagaccagcctagccaacaggacgaaaccctgtctctactaaaaatattaaaaaatcagctgggtatggtgaaatgcacctgtaatcccacctacttgggagactgcggcacaagaattgcttgaacccggaagatggaggctgcagtgagcaaagatggcaccactgcactccagcctgggtgacagagggagtctctgtctaaaaaaaaaaaaaaaaaagcaaaacaaacaaaaacaaaacagtcgcttctgcactcatggtaacatcctttaccatttaatctctcctagaagacagggcattgccataccattactcacttgaagatgagaagtggaggatttgttaggactgcaggtgatgaggagagactcaaacagaatgttagattctgaccgatctgctctggtttcacacacttctttcccttcctaagaatctgcttttcccttcatgtactttttcctgttttcagtatcactgggtcatttctagtaactctgcttaagtgatcctgtcagctacagggcgtgggtgggttattcagctctgcctcacagaacactcaccctccatctctgagtcagttgccttttaatggaaatactattcgctgatcatgttcataccggcccagttttgtttctcttgacaatggcccaggtgtttttctcttctgattgagttttggggtaagctcagcatctttgttgttgttgtttgttttattacatttccatttttactggaggggaaagatcagagtcaatgtgatccagctgctgcacgtcagtcccgccacatgacctgcactgttacatccaaagcgtgcagggaaaaggctgcgtgctcaggtccagaagttcataaaggcagcctctcccatcagctcaccggtggctgccagcctccatgccgccttgctctctctaggctactggtttttgcaaccttctgcttttgtccactcataactttgataagtaccgtgtcaccttctcatacgtggaaaacatgtggtcagcgattcggcatgtttaatggtgcttgaacaatacaaaggggagctgtcatccatcttttgttttctcattatcagttttcaggccacgttctaaacaaggacgacaaccaacagaacatcattccctggtgtcccagtccttgcttactttgaatctcctcaccaccttcagtcctttctaaggtcacgtacgggcatccaccgtcttttttcctaaacagaatactttgcaaagtcaagtattggcatttcgtatttaagccatgcatcctcaaggaggctaaaattagttcttgaaggatgaaaaacgtcttattccttttctgtataaagcacagatatacctaaatgtagacatacgtatatgtataatgcaaagtactaaaacagtatatctgtggtattaaattttcatgtgaggagggacaattaggaaaaaaaatcagaaaatgctttttaggaggttgatcatgaaaacaggaggttggtcatgaaaaaaaaggttgaaaaacactaatttaagcctaaatgtaactacattacaaaatgtcactacttcttgctggttttggcaccagtgcctcaggtgacacagaaatactaagttttcttttattctgatatgcttaaggtatccccaaaatgatttctctaagttgggaattgaaagggttatgttacactcattcactctttaacaagtcacatacacgtcacctcctattttagaagccaatgggtattaaagcacaagaaataaaaccactgaaaaagcaaaaaataaaaaggaaagaaataaagactcggcactctgacacagatgaagcagatgattatgtttatttaaaacagcaacttattttttaatgtctatgaactaaagatttctcaggacatcttatttcatgttaagtgtccaatgcagcaatctttgccttgcaaagcccattacaaataggcttgtgcattccagaaaggaagcatgcatttaactttcccaaatatgtaatatgcaattcttttttttaaattttttacttgcttggagcaaagactgaaagcaagtatttaatctcgcttcctttgccagtgcaaacgtaactaattctgatcctcatttccatttcttccttaatctttttaaatcagggttgggccagcatttattcccaaccttttggagaagtagcctgtatttcaaatggggccgcgatgctaccgcatgttgtcctgaccagtgccgtcctgatccttgctggagaaagaaatggaggcattttactcacaatcacagagcttacgtatgccagcattacagaatgcaaaaaataactttgcaacaatctgaaagggtaatttatggagcgtggacagtaaatggggtatgttttctgtcctgaaaatcccagatgagggcaggcttatgaataattttcaaaaatcaggaagtctgtggaaatccctactgtcttataaagattgcaccgtgctcatcgcatctcccacggcctctgcctcctcctccacctcctccgaggttccttggtcctgactcctaatggcaagggccaaagaacacaggcacctgcctccagcaaatccactccgattccccctcattcccagacacaaatttccatgaaaaccagacagaggacagaaagcaggggcaggatattccaaaagcacttcagatctgcagcctgatttcattggactcgctggcttgtttcttttagtccctgggtgtgttgactgcaggagaaacctcactaacgacgacacttcagaactgtgagtccaaacacttaaggaaggacgtgcccaggaggaaggtctagaagctcagagacagtgaggaaggggcattgctcagcgatgcttagatgccttcatgagctgactctactgggagtcacttgtcatgcccctgaatccacccacacatctctataacatatgaaaactgttcagcccaaaggaaaaaataaactcgatggttctcattaatccaagtttaactaaacacaacagtttccaagagtacatttcagccatttcgcacccgcagatacccaacctgagaagctgatgggaaacggctgttttggcatcaccgagggctgcggcaggcagcacccagggggcttctgtctcccctgtggcgctgcagctgagagccacacccatgagctgatgacgtagcgtttctctcaaaggtctcccttgatgatgtggcaaactgcaaggaccaagcacagaggcacctggacaccaacccttccctgcgagccacatggccagtcaaacgttctggttaccggggatgacacgctttttccgacaagattttaagcacttgtggcttacatcaatgtggtctcgtattcattgtgtgtttagaccacttgcctcgcacgttctcatatttacacatgttcactgaacgtaacctcaagtgaattatttaagaagccttaatgtgcttcagactgctcaaatataatttagactttaaattaaatttgtactctgatacgaaactgcaatgcttgaatgcagcttacggcatcaagtggacatgcaggaggccttggaatagaatttcagttacccctaaagggctcacacctagtggcccacgttccttataggacgaaacaagattcaactacaaaatccaactcattgcctacgtttgaaagctggggagcctgcagtacacaagataaagtcttgcttctccatttgtccttacgtgaccctacaatgaagcatcgctacacaccagagacgtataatgctagacgcgagaacacacagtcatgctccttggtcagaggttttgggtatggttgggtgttttaataaaccacaatattccttctccttcactgtttggttaccaataattgtgctgccttaggtgtaaaattcaatatggtgattagagtctagagaagccacacttattttatttagcagtttttgttttatttttacagtaagcactgcccactgggaaaaataaaccaaaataaaaagagtgaaattcccttattatgcactagcgataatgaaaacaaacttatctacaaagaaccacagacgagaaatttgcctagagaccagctactggaactaaaaacaaatttcttattcaggaaaatgtgaatgagtaagaatctgctagtgaagtttcttactttgcacaaaaaattaaatgaaatcttaactttaagagtagcataggctgggcacggtggctcagcctgtaatcccaacactttgggaggctgaggcaggaggactgcctgaactcatgagttccagaccagcctgggcaacatggcgaaaccctgtctctactaacaatacaaaaaattagccgggtatggtggtgtgcacctgtagtccctgctactcaggaggctgaagcacaagaatcgcttgaacccaggaggcggacgttgcagtgagccaagatcgcaccactgcactccagcctgcgcaacagagcaagactctgtctcaagaaataaaaattaaaaaaaaaagagtggcatagttaaaagggtagaaggttactcaatgacgcatcacgtatagtacacatatagcacactgataataacaaatggcatgtaagcactgtggattgacttcagaagacttttccataagcttcagtatcacaaacgaagggaaaagcctgtgttatgtgcaacctgtcatgatcaaatagtgtgaatatgtccttgtaaaggttaattctatagcaatacatttagttgatgtgctttcttcctctgggattctagcactttaagaatgccgttcttcaaaataatcaattgtattattctcaagaaacatgcaaaataagaaatttgtcatcaagctggaattatctttaaatagaggatattcaaatagcatttttatgcctggagttgtcgcagcatgattccggcaaaagccgcactatttgttagctggcacacagagttttggcctgaaattcagtattttattttaccctttaaaagcatgaagtgactcaacaggaaattatacatacatttttccctccaatgtaaaaactgcagatctagtaccgaacatgtcacgctggcattcaattttctattgctatcatatctggttccttagtgacataaggtcacaaaacttctactcctgtggccaagagacataatagatgttgcggttgctcattatattaaatttgaattcctaagctaaacattctagacctgcactattcggcatggtggccactagccacatgtgactatggagcccttgaaatgtgaccagcccagatggagacgtgctgtaaatatacactacacaatggattttgaagatttcatatagaaaaaaaataaagtcaaatatctcatccatattttacactgattacatttgaaatggtagtattttcagcatgtgttacataaattacattattaaaattaattccacctgtccctgtcttttttaatttggctactggaagatttaaaactacccttgaagttcatgttctatttcctttgcccagcactgccaggaccttacacggactctgcctccacgtcactcgctcccttccggtcacttccataacaggcccgccactctgaccaagataactacacacagcagagtcccatgggtggatctcagcatccgcctgcctggttctgatgctgccctggttcccactactgtgtgactccaggcaaggtgctcagcactcctgagcctcactgctattctggaaaatgaggacaattagagcacctcctgcaaagagccacagtgaagacagtcctggcaaagtgtctcctgtggctataccatctggtgagtgaatgtcacctgccaccttccacaacatcacacctctcccttcccttatgtaagactgctttcttccctacctcttaactttacacctgagatattgaagtaggtgtctggtctgatccctccaacactccagaggatttggtcagtttccacactgtgtgacccactcccaggtaacacttccaccctccaaacacaccagcaggcctgactcctccaccctcccgcccactgctatctctaccattcccgccaatccagatccaacacgccatggcacagctcaagggcctcagcctccgggtagcatgctctgatcctctgatcttcctatggaatggtgtagattgcttttggattgcatgattctattttatgttatttatactctaccttgttcccaaaaagggactcaaagtggtctacaaggatatatgcaatatgacaaggttgtttaaaattcagaagcaaaataaaaaataaagatgaagctaaagagaaacaagggtaagaacataaactcgagctaggaatgcaatggcccgccaggcaggcctcagggtctcacatatctgctggagttgggtcattcacacgtctccaaataatgaaatccaaccaaatgctcagacaatgactcctgatgctaaggctaaaaatgaaatcctccaatgattccataagaaagaaggacctgtgtgatagcaagcatgcccaagaacggccctacagcaaacccagtgtattgcacgaggctgtctccctgctcgggaacatctcctccattgccatacagtctagagccctgttcactgccatgctggcccagttcaaccaggtggtcccactgaggatgccactcttgttggtgtgtgaactcatctccttcgagatttcatgatgtgcacattcacccccgttctagatttcatgacacaagcattcaccccttttctagattctatggcaagtatgttcacccactttccagattgcacggcattcgcattcaccgcctagattctagattccacggcatgcacattcgcccactttctagattccacgatgtgaatgttcccctcctttctagactctgtggtgtgaatgtctgccccaattccatggcattcttgctcacctccctttctagattccatagcatgcggattcatcctctttctggattttgcctccctgaaggcactgtgcaagtcttctgcatagtgtcttgcatgaagtcttacacagaacataaggcaaaaacatggactaaatggacagcttgccttccaccacacagtctgtagcttctagcctcccttcctttgcacgtgcctttcccaggatccggagcaccccctctgtggatggagtcctgtatcttctcaccttgagtcaaatctgactgcccgctgatctctgcctactcagcattccctgaattctcaggcattccacttgtcctgtattaatttccacctgtaggtatttatcctaaggacaccgcatttagagtgtccttgcaagaggggatgctcctctcttcagctaaacttagctatttaaagtaaaaagggtggtagttttgtttacctgttaacacaactcatggaagagagaaaaattcaagcatgccactaattgctgcagtcagacagacaggtggataggcgggctccatagcggaatgttctggcttctcccactaaatttgcagttgttcgtctaatctctagacgtgtcccgtgtcttaacagtccctgtatgacttatgctcccacctcttgtttgggacagtgctctcatttaatagatgctcaatatattttaattaagaaatgtattttcacgttgcttaagacccataaagaacaattaatacaatgtaatgcttaattttgcaaagaaaaagtttatattgatgctaaatgcatttacaaatgtgctcgtaatgtacaaacaaatacagcccttactgtgggttacacatacttatgaaatgattttattgacttacctttggttttacaatttggctatggggtacttagaagaaactgcccttgtgggacattctgtctaatcacttatatttacaagccttagaaaactgtaaaaatatattcagtttcattaagagatattcgatcttcagaactgatactatttcatctataaaatccttttactggctgggcgcagtggctcacgcctgtaatcccagcactttggaaggacgaggcgggcagatcacctgaggtcaggagtttgagaccagcctggccaatgtggcgaaatcctgtctctactacaaaaattacccaggcctgttggcaggtgcctgtaatcccagctactcgggaggctgaggcaggagaatcatttgcacccaggcggtggaggctgcagtgagccaagaatgtgccattgcactccagcctgggcaacagagcaaggctccatctctaaataaataaatacataaataaaatccttttactttgatacctcaagtagtaatcaataatatccctctctgttctaatggcagggcctttaggtaaggtttcagaatttgggataaatactaataatatgctgatctaacatctcttctccagaagactccctagatttgatttttactgtcattatttctattttaaaactctgtagtgaagtaagttttactgtcggggtcaaatagactagaaagtacttttcaatactgaagaagcaaatttttcctccacttttgcttattctgtcctcttgctgctgtatcttgaactgcagaaaaagcaagccttgcacaaggcaagtttaaactttgtgcaattatagacccagatttgtaaatctggcagcaggctcacatcagctttgtgaggttgggtataattttaatgagaatccattcaacatatgaaatcttagaatgtttctcaattagcacttggtttcttttcaaaatgtttttacctcatttcctaataaaagaaatctcagctttctgatacatttaattaaaaagttttatgttgagattgtaaatgtgagtggtttctgtttcaaaacatttcattttgctagtacatccttcacttattatttatactctgcttagatctctgcatttcccatgcaaaaatcctgaaatgcaccttcttcagtgctgaggtctaaagtttccccttcctaagtagtgccacagtcaccccctcttcctcccacagggccctcataatagcttctttcagtccttcctctgaaccctgagacccccgttcactctcatgtcaagcagaattccaagccttcattgcacacagaggtgggtccagggaggtatcccgtgtttctgaaattcctgctttgcctgtgcctaagcttcccaattctcccaagagtcctcattttaagaacacaatgcaatgctagcattgcactagcattcagcatctcccaccatacattgcaaatggataattagcttgattgctaggagattcacctgctatcccctcttctcaccctttagcaatgtgtgtggaacgcacttggctccgaacaaattaattgtgtgtgaggggtgacatctgactacgaacaactaaaaagaaccatttaatcaggccaaattcccttcaggcttattgaggcttgagtgtggatttttaaaatgtaagcagcactgtcactgtaaccatgaaactgtcatggttttaagaagtgaagttttgggggacaacaacatgaccaacagactctacctcagcatccagttcccagattagttaatacaaacttgggccccacttttcaacagaagcacagctctaagtaaaggctggtacccagctctgccccctcaaattatttggtgaacaggccaaatgggaggaattgcaggtagtactgcagaatctgcctgccttggaaaacaggctttccatgaaatacagttttaaggtccccagaggccagggctctctccctcccctactcttcaccgcgccccccgccaacccacacgtgatgagaaaccactgcccctgcagaggccccagcagcaggcaagggtctgtggaagaaagagaggaatattacaaaggggtttctggctggaggggggttccagggagggcagagaggttcaggctccaaagctggcagcagcccctacagatggaaagctccagtgacaggacccatgaaaggacactgcagagcttgtcccatgtcattgggccatcgagacatcaagggctgcctggatttcaggaactcacatctgtagaccaagaaggaacagcacgttcccattgccaatttcaatcaatttattaaactaaggcaataggtaagtaacagatttactaagatattgggattctcttactgtccatcttagttcagatggagattcacaacaccagctaatctgattccaggatgcagcttctgacggtgcacaagctaatatttccttaagatagtcacacaaacctccctgccaggcgtgcagaaaaatgtgcacgctccaatttagtctttcttttactttccaactttaagtactttagtgagccccaagaatgcatagccactctttccacccagttagagagaaaattaatctttctaccaataacagagaatcacttaatggaaataggacgatagtacttcactaaataaggcttcgctcctttgctcccctactctcaaaactgaggttcaaatgcatttctacactttcaaatgaacatgtgggaacttttgctgaatgctgacatcaagtgaaaataagggtttcctattttttaaaagtcattctatatatgcctgttttctttcctatttcctagagagacagcttttcccccccgagtatgttttgcaggggtaataattactgcaataatgttatccttaaaagggagcacatataagacaaaagcaggtacaaaaatctcattcccactaaaacaattcaaaatcataggttaggctttaaaaggaagcaactacaaatctaggttttaaaaacctttagacacactaaagatttgtcccagatcacatctgatgtctatttctctgggataataacaaaaaaaaagaggtgataaattaattcaaatggcctattttacatacttgaaggatatttccattgtctcatatagccattctgaataggacagagtcacataatgaaacttcctttgcacattctcctgaacacgcactgagtcaagatagccaaaccccttactttcattgtaaaattactgtttctcatacgcaatcagggtctcccagattatgacatgcgaccctaaaaataggagaacttaaaagttagtttaaatctaaaacttagatccagcgctccatttttagatgcaccctttaatttcttggttttgtctacattttacttatacttaaatttagcaaagtaattttagctcaccctccttcactaccttcactagactttgcaatgttacaaacatgaagcattcaagcctctttctaatatgaaaatgttttaaataaaagataaagttaaaagggaaagatgccccttttaactttaacttttaacttttttagctatgttgaagaactggtttgggtgacagcccagccattggaaaagccattggaaaactcccgctgttgtttatttacaaaataactgctttcaatcaatcattgtgagaggtccgtacactgacaatgcataatggacaactaattaactgacccctaataagagtgtgggaaataccagggagaatgctatcatgcaaggaacagcaacaatatggaggggtggctggtcactgccaagcatgagcatccccaaataccgcagtgattttcagagttttcaaaaagccctactcacaccactgccactaagtaccataatcatcggaaactgtgccccaaagatctgaacgtccctgttacatcagcctatttttcttacaaatgttgctgctaaggttcaaattcaaggtgtagaacattaaacaatagctgtattgtgaaggaccatgctccctgggaaagcccaagtaaccttacacactggggaaggaaaaaagaactcctttgccatactcctgctctctggaaaactgctcagacgcaaggggtaaagaagcaaagaggtgacaaaaagagacctgcattcagagagatcagctgtcaacttaaactgagaagtgacctgatgcctcacagagctgggattttgccaccttgaccaaactgcttcccaggctccataagtctcattagaaacgtaggtggctctgtgtcgacaccttctcaatggagttctatgaaataacaggcatcagacatttattcactatgacaatgtcttcccaccactccagatcctatgaccgggactgacttgctatcggtttttgcctgggaataggaaacgattccagaaacattagctcttctgttttgagaagaaataaattcccccttttatttcttttttgtttaaagatagcaagataaaaataaaaactaatattacttttagaaaaaaaaagtgttgaaagtttcctattaccctacttacaatgtgagatgcatttaaaagatacataacgtataacattgtagaatagtatgtgagttacacattccttctgacgtctttcagagatgctttccttcttacttatgtatctggtattccattgggatcttaggtcttaccacaaataaaatatctgattttataagattaaaaactcaacaaggtttttctttaatataaaagcaaaacgtggaacgtggaggggggaatgtttatatacaggtgtgaatgcagcccctcacacaatcccttcaatggtaaatgctaattttctaaattttagctaaagattaaatcaccaataattcctcatgaaataacagataaacgtgaaatcatgtactacaattctactctaaatttttttaaatagaatgaagtaattataaaatgttacaaaagagaagaaactggaattataagtgctactggaattatatattccttaacaaatatcttgagacggattacccatttgctaattcagtgtactttccaaaagccattgacccaaaccgaagctaggattaccaaatggcaaatagcatttgtgatgtgtgtagctcttctaaagcctttcttgagaattgtaaaacttgatatattagccacaagtttacatagctcaccgtttctgctagaattataatttcaatggtgtaattagcttattaataatttgacacatggtgaattaatttacatggttgggttcttcgcaacgtctgttgcctgatcctcctgtggatgaaggctatgagctctggcctgccccgggagcgggcaccagccaatgccagcggagcaagggttaactttgggactgtgacagttctcccttcaggggctctaaactacttggagagaatggaaaacagtcaaaaatagtcccaaaggtaaataaactctgtgtcctatgtatgtcacccagggaagaataaaatgtatttttactcacattgaaagttttctgaactacaaaagctatagagacatgtacagagtgaaacctgtagcacatacgaatatgttattttgaaagataaaggaaactatctttagattaacgatgagttgtattaaatccacatcctcattgaaattgtttatccattttattgcgcagtgtagtctgctattaataacagaatttgtcctgtacttaaaagataattaatgcctctatgcatctatgcaacataccatagcaataaacggacgatgtatttcagacagaaaccaggtaaggctagctgataaaatacagactatattttttttaacatgccaagttttgcaattagggtggtaaactggaggcaaataaacttaacagctgcaggctgaagaatggaaaggtgaaaagactgagactgagagtgggaaaggaaagggaccgctcctggcgctgagagctggtcccagagccggtgttgcggggtgtgcgggaaggcgccgtcgggggtcattccaccatcaggacccagcggacagtgacaacccagcctcaaacctggtccctactttaggccaagcgtcagcttttttagttcaaccctgatttccactccagacaaggacaaataacctcttggtcggggccccagatgaagtccccgcggtgtgctctcctggcccttgtcaatttcggggtgccccctcctctccatccgcacccgactgcacgcgcctccctgggaccccgcactggcgagccgtccctcccggcgctggacgccccacctgtcccggcgccgtcggaagagccctgcagagtgagcccctagggccaccccgctgccttcctccccgtccccgcagccgctgtagccagcgtgggagccgggcaggtcgcgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccgagccgggtcgcactaactccctcggcgccgacgggctcagc

SEQ ID NO: 2626 - DNA, 281756 bp, Homo sapiens
tttggtgtatttttgagtagtccaaagtaatttttattctctaattagtcacctcacgactttatttgaatgaattaatgagaagctaaataaactagctttttaaaaaatattttcttctctttctccaggcaatgggtcactttggggcgctgcagaacatctgtgctttccctgtgccccatcaccttcccagctcctgagctgtagccatctctgctgcacctgctgtcagagggcagctcctccggctcctgctcctgggttgcaggtgccacatctgtgcagaaggcttaggagaagcagtgagccttctaactgcagcagtcctgacaaagcactttgtgaacccctccgggacataagggcatcaaactaggaacaaaaacacagtcttgactgtgatttggtgattttaccacatacaaggcccgaaagccaattgaagacaagaaaagaagacaaatctcttgccagcaggagtaagattgtacaggagtctgagtatacatcagggcaagccaagagacagggacaaacagagagaaaaggttcatgcaattatgaatatgacctggagggggctttggaattagattacaacagtaacagagagttaatgccattttgaaacaatttaagaattatgtatttgaaggaactcagtattatcatgttatccaaaattatcccagttgctcataagacttgctaataacctggactgggggtggagggttgagggatctaatggaaaacatctgttaaaattgaatatgataatcatgtcttgtttttatgatcttgctcatgagacagtcttgaagagagaactgagtgattatccaagtaaatgtgtatttctatgaagaatgtaggtgtgtcttgactttgcattccaaaataaaaatgactgatcttttccattagcacagtttgggtcagcctaactgccagctttcatgattgtatttatttattttccctaaggagatacgggcactttgtgggccttcccaggctgctgcaaaatgatggatggttgggctccgtctaatccaaatgacacggggtgtcaggagcattggtaatcgtgtcctgccgacttcaaagcccactgccaaaacatccacagcacagaggtttggcaacttcacataatcatagcaaaaggactgcaacgtgaaaaaaacaggccctgaaacagctatgaaaagggccagttcagaaacctattcagctaagatgtttcggctagcgccttcgcacggtcaccttgtattttcaccttttgagttgccttcacctggaccaaggttggcagcatttgtgattcaaagaaaagatgcccagggaaactgactctagattatggaaataaacattgtcttcaagggatagccagcaacatcaggctcagggctagtgaatcccaagccacagtgcccaggtaactctgatgtagcaggactaaagctgtctacctagtgagagctcctgaaagagaaaccccgcagcaaatctagacgttatcccttgtttctgtaaagtgagaaattgcagctatccatgacgctttatttgccagtaataatacagtttgccttacgagtggtagcttgttcactgttcaacaaatgtattttaatcatagcaggaattaagggtgatttgtgaccaggtgctgaactagaatttctcaatgacaaccccagcttcataggcctctttccattccaggcataaatatggaggctccaatgtgaaacccggggtccttctgttccaaaaggggctagaaataaaagacaggaggggaggcaagaaggacctggagaggctgacgccatttgggtgccaaacatcctatttccttggctctcccttgcacaagttcctggacaaagtaaattataacacaaaatccacaacattcagcacatgttttcattaagcaactttagtcactaaaaaaagtgcaaatgcagactcctgtataaatctgatttgccatgctaggccaagcttattttattacatacattctgcattctaagaactaataacttcatattgtaaacattaagcatacagagttaaaattcaaggccacattatatcgattgtctcttttgtcgtgtgtctttggctggccgagatcaactcgtagtgtataaatgcataagttatataattattatataaaaagggggaaaaacattgacttgtatacttcattctgacaaacgcacagcgttcgcgactcaaaggaaaactggaggccgcctacccaaaatgcctgcgtgatttctgattgtggcagccaagaaggccatctcttacctgaccctgtggagaacaaagcccccacataatgatgaggtcctgaatgtttctcttaaatatcagacaattccagttaaaattttcatttgacaaacaaagaaagagatgcgcatttttgtttctgaattctactacttcccctttctccattacgctgtgtcctttctcctaacactgggtttggtataacactgactgcatgaaccctcgagtctccataactcattgtacacagtccccaaatgtcctgagtccagtcttcattgcttgagaagtttctttcccagccctggtctcctccttctctgcctcttcctcctccttcttcacccctctgtctacaatcacacgctcactctatacacatcctcagtcccaccttttagttcatagtcccggtaatactgtaaaggagttggaaactttgggtcatcttcacagtttgagaaagctgacagctgtccatcaaacggaatgtatttgatttcaaccaaaacagcacatgccatgcagttgcatatcaacgtctgttgatgggccacagtctctctcgtgtcttttctcttgtttttgatatgtttctatttttaaatacaggtagttttccttaaaatggcattataaacggtatgttaggtcaaaactgtgttgtttctattgctttagtttcatcccagtttgcattagtgggattccaaactctactctaaagtttatacatttcttaagaccactttctttggcactttgtccttaagacttcatgcttctacatacactgtcttttacaaggtcagtccacagatgatatgtccatattcgtgacatttttagcatcctcctcatttctgtagtaagacttcagtaactccctcccaagagtctttggatctcttccccggcttccttccccagccccagtaaagcttttttcattcctcttgaggcacttttgattcatgttctccgatagagtttgtggcgatgggctggtgaatgcacgctgatgggaaaagcctccgccaggtctttagtagtaagtgcccagatgagaaggcatatggctggtggggagcctagtgttggggtatatacccccagttggtgaattccagtatgggtttggggcagcaaaaaaactggaagatgtcacggggagggctggagggtggggcgccacaaagttcatcttctgtgggtgggcgtgataggagcccatgtacgggaggtctgaggggtacttgtacagagatgactccggggggtggggctggagggcctgggcgatcccgtggaagtcgaacttgtaggcgtagcgcttcccatggaccttggtcatgatgttcttgtcatagtagtaacggagggcgcggctgagcttatcgtagttcatgttgggtttgctcttccgctctccccagcgccgggccacctcgtcgggatccgtcatcttgaactccccgttggtgccttcccaggtgatgcagctggagttggagctgtccgacaggagctccaggaggaactgccaaagctggatctggccactgcctaatgaggtcaggagaggaaggaaaactccagtgagcacaggttccaggggaaagaggctctctgtgatgacggaaggaggtgctattggtgtgccgcccacattcccttcaccaggcctgtccgtccatccctcagctgcaggggtgcggactgctctcgttccatggccacccacttctccagagaactgcccttgcctgaacagagccgccgcctcgcccacccccaggtatcccacagctgggtggactgaacggggtaccacgggccggcccccttgcctcaaggaaagaccaactccatgacgctattcaggcttcagggctcccgtgggattgggctgaaacagcgtccagctgcaaggaggcttggaggaggccagaaacttccttagcgctgcccctgcagcacttcccattctctctctcctgagaacatgccgttaatcagtcacctgcacaagcaggcttaccccaagctctgcatcaagggaacccgacctaggacgatgatctaacagattcaagacctagatggaatgcagcgaattcatatggggcaaagttcaggctgcttccatccatttctgacgtccttaaaagaacagccagatcaacctggtgtttaggggatgaaagagctatatatttttttttcctattttgtgaagcacaaagtactgttatgtggatggcaataatgacttaatgccatttatattggctaggtcaagtaagataataaaagttagatttaggaaatgaacttctaaaagtttatggaaaaaaatcgagaatggaagtaaacaccattatttctaacataacattttgctggcgctcagaaagcaattctgtgaaaacttttcctagaacagaattaacccactcaaaatgaggaagtttaggaaaaaaaaaaaaaaagctggctctttttcaaaccagatcacccagttccagtatttgggcaagcgcatcgtaacggaaaccagtgccttgcctgtgtgctgcaacgccaattgtgttaagcagcatttccagaagaaaaaccccaacaatgagtgattgcaagtccccttgggaagctgaatgagactcttcctttgtcaaagagatcacatttagctgggtggacaaagtcagaattttcttgatttcattgaaatcatacagatacagctttgttttatgaaattcaaagaaaaatctaggcacatcattctagctgctatgttacaatacttgaagatagtttatggctccctagaagacagcagcatgtaaatattgacagcagtatccgtaccaagagaagctaagctgtgctgaacatatttcagaagcttaagaacagatgggaggtgggtctttcctcccaaattccagttacagcactgccttagacttattaccaaaagattaccttttattatagtgtaagtaatatcaatcgatgtgataaaatgattaaagtaactttaactgacatctactcagggaagtaatatactgtaaaaatcaattttacgttcattttcttctaaatcctcgctagcctcctgtacatatcacccaacttataaactctgctttgcatgttggctacatggacatggatatttttgtgaatttatccatacaatagcactgtgagaaaggtcagctttttctgaatctatgctggaaagtgctcattttcagtctagcaacacatttgaaatgtattaacagcttgtagctcattgaagtggaagcctttgctttttcagaaccacatatacaaactgttcccaatcaagttttgttgcctccaacattttattaatatgcatttagaaaatacaaagaatggtatgagaaaaccatatggtcttagtatatatattgtaaccaaaaaattacaacttgaaaaaattccgtatatgacctgggaataggaaaaggcatggatttttgatttaacagtctaacagatgcttcaatataaacacatacggttgtttgaaaataaatattcagcgtcaactttctcccatagagaaagcaactccacagacctgccgaaatcacacttggaatctactcaaaccttggcattgcctcttagcaatttgtccctcacccatttctcttataaacgtgtgtaggacagaatcagtggacaaaagtgatctcatgtctctcctatttctgaagagttagaaagcaggggacctaaatttgtggcagcaaactctatgcccaaaggatggatgagctaatttctcacttgactattttacccagtagccataaagacatagggctcaggactgtgagaatttcaagggagggtctatagaaataagagaactgtaagcaaaattcatcagctttcaaaccttgaaagaaacctggaaatgcaaaatcaatgaatgtttaagtaaatggtagaaagagtaacatcatgtcaaactcattaattgttaaatttaatatttgtaacaaaattcgctgcattttgcagtgtgtagaacaaaatttctcactgcaagaattctcaaaaatgaacaatggttgttaaaaaattgtcagtggtaaaggaattattctcagtcataaaattttaagagcaatttttaaattcttattttacttccaaaacaataacatttaatgtgtgacgaggtgcattttagaatatagaatagagatttccaaacaagaatgcttagggtttaggaaagcctaaaagtggcttgggtcactcatgggccaaaccaggatttacaaagagaagttcttgaaagacaagagctttcattgagtagcatcaccacctctaccttaggactcacctttcttgggtaaacccttcagatctattttttttttttactctctcttaataacatccttgcgatgtcagtaaggaggaactaattttttcttagggtaattaccaaaataaaacatatttggaggtaaaaaacagtggcaagcagcattgtccacctacagagaaccctgtgggtgaaagggagcggctgtggcttttaagaagacagaggcactcctttaattttacagaggaaagtaatctcctaatattgttaaaagaaagggagagaaacagggtagcaaaggggtacagactgagcaaaaaagggggaaaaaaaaactaaacggtttacaaaccacagagcaaagcagagagctgcagagtgagtcagcagctgtgtctggtggaaacagcatcctggtgcaaagccctgcagccgtcagctgatgaacaagggcagtaaatacagccgtgaggggccccaccagtaccatgtggcagtggtttggggccactttctctagaagccaggggtggtgcagaagatcccgtgtgcatggcctggaccctctgcaaggcagcaggtgtgtccagcaggtgtgtcctgaatggaagtctctgccccgaggctcagtgaggctcaggcaccacttactggaggggcaggaaagcatggtggtagggagcaccaactttggagttgccactgcttcagctgaatcctgcctctgccctttgtgggacgtttggcaactctcgcagctctctctgcctcagtatcgtcatctgtaaagtgggggtgatggtaatagtactatcttgcaagatcatggtaaggatgaactcagtacttgaatggtcttgtcagaatttctttgggctgaaaatcagagtttaaggaaagataacactcctctcctatagccaggaaatgcctaaagaaagagaaatactgttcaattggcctattgaaccatgaagaagcttgaaacggtgctattcttgggctgactgatatcctctgaaagcttactgtgtgccatgcaccattctaaacgctttacatgtattggtttatttaatccccacaggaatcatgtgattagtccattggagaagtgacgaaattggagcttagagaggtagactgacttattttgcttagcgttggcaagggttgaaatccagactctaggctgccatgcttaatcactgcgcaaacttgctttcaggcctggtttatgcacacctctgtagcctcctcaggtcctttccatgttgtcccctccctgggggactcccactggaagactgcacactgccacctcctaacaaatgggaaaacatccctagcctggtctgtcgttctgcaagaggcaggatgtattttcatgtgcaccattgaagagtatccagttagcatcaaggaagcctctgaacataacccaccaaagctctttcattagaggaaccatgttagatagattctcagctgctctgatgggatgtaaaggagctgtgttgcttataaccgatccatgatatcagaatgcagggacacactgttctcagcaggaaaagtgatgtccaaagtacacatcaagtgaatatttgggatagagatgttgggatgctgacatcatcctgtgcattcatactatatgatgcaatctttccacttaaaatgatgaaaaggaatttgtattgtatgaagagcaaagacagcaatttttaagtgatgaaagatttatttatcagagaatagaaaaatagaatcaaacaggaagaagcattgtcattaatacaaagataaaagacattctggtttcaggggaaaagttcacatgagcacaacagacacaaacctaaagatagatggagagaaagtcaaattcatcagaaactaaatgaaataaatctttatcttaaagtcacttgcctgcaaatcaaagatgggatgttgccattttctccaggcccattaagaacagtcttaatggtatgaagcacagtcctccttccccaggcctgtgatgagtttccggtctccttgctctgagctcaggtccctctatctacaaagggcatccccgggctgctgggcccagggcatatgcagtgttcccttgtgaaagctggcactttgcttaggagcaagtgactcaggccctattctacaaacaagccaagcagtacctttgggctgtgacaacgtggtcatggacatatatgtttcatttggccaatgtgtgagtgcaaaggccagtttggtcttctttggtgcagcttgactctttcctcctcttccttcctgacctcagattcatcgcctgcacctaagcagttatgaccctgaaaggaaatccttgctttctattctcacagtccgcattttgtaagacctcctcttcccttcatacttagtcagtggcagagtagggcaagaaaacaaaagtagactttgcagacagagtcaggtttctaacctgacctcccttatcattggctgtgtgacacaggaaaagttacttaacttctctggacttctaattccttttctgtaggatggagatagtaacctcccagggctgttatgagacacagaagggaccacagacattctatggggggcattctgcgggatgggagctgtttgattgttatttcacatgattgtattaacattcccagagtgtttcagcttccgtcattttcttttttctaatctatcctgaacattgctgccagatcagtcttcctgaagcatgactgataataatcatctcaaaacatagtcattatttttatttgaatggttatatggcagagttgcaaatgaaaagctgagcagaaggctgagaagagaccacagcctcaggagcctgggctactagatgaaagccagcatgagcaaaaagggcctgtggctctgtgtttgggacaatgttgtaactacctgtgtccatctctccacggaccaaaagcaccctgagctaaaggactatatctcattatccttggcattcatgtatgcaacaaataattattgagcacctagtctaggccccaggctaactagttttctttagattttcagctgtgtaaaaaaaattcattgaattcattaacattaaccaaaatttaacttcaaaaatacagatgttcaataatgataacatttcgtgttttcaatgtgtagattctcttgcagggatgtacactgattaaatcttaattattccatttcgaaccttattttggcctcaacgtttaggaaatacacattccatcttgtgcttgcaatatgcctgtaacatcttggcatttgaatttgcagttgggaatatgcagcataggctatgaatttctgaagctggtgccagcacagctggttctgatctgaatacaaacaaataaaactatgtggttggcactgaaacactaggacaggtgacaaaccttggcaatgcactggttacaaatgggctaattaagaatctgcactttcttctagcatcgaagttcagaaacagaccatcgaagatgagcctgaatttgaagtcttgtggttgtatcaaggctctcttttaaaaaatactagttattttatctgcttgtataatgggttgaattgtgttccctcaattccctatgttgaaatcttaacccgcagtatctaagaatgtgaccttttttggagataagatcctaaatgaggtaatcaagttatagtaaggttatggggtaggtattccaacctgaccaatgtccttatgcaaaagaggcatttggacacagagactgacacacacagagagatgatgatgagaagagacacgaggagatgatggctatctgtaagccagggagagcccccaggacagatccctccctcacagccctgagaaggaacgaaacctgccaccatgacactctgatttcagacttccagcctccagaactgcgagacaataaactgttgttgtttaagccacctaatccgtggtactttgttacagcagccctagaaaactattacagcttggattaggttataatgttctttgctgaagctgaaatcttaatttataacccaacccatctttccattaaggcaaataattcagtgagacctaaaactaaaatctgttcagttgaaggaatttctcaccaataccaatttacttttcaaaataaccactgccaaaaagtaattttgtaagaagaaaatcatcagcagtttctcacctggatttgcaaggcggctacttgttggtccaagaatctgataaggatctacagcaaaaagaaacaaagtcaaatcctagacatagttgtaacatagtatgatgtgacttcagacataatgcctgacttaattgttttttcagatttcagagccgaaaatgtcctccaactccaaatcaactgcctccacctcctctatgagagaagatgtcacacggcatctcagatgtcttgctaggggactcctaattggtggcagggcttggattcaaccccaggatcctgacatatagctcaaggctcacaccaaccaatgatataaagagggcaaacatgtgccaagccccatcaatccagggccgtgcaggctgtgttgtttaggcatggaaagtaaaatctaaaaaattaatggatcacaaagaagcagcctgtgtgcacgtagaatttttttccctatttattgcatagttggggacgtgttttagcaccatctcaagtcacctcgcatgagtaggctgatgacttgggccctatcttatgtatggagctgtcgaaaagaggcaaacaatcatgttaatttccattaaaaagtgaagcattttagaaatgtgctgctgagcctgaatcttctcttatggttatccagacggcccctgaaacatacctaactgaggacgctggtcttcagttttgggcactgtggaaggagatggttgagcagctgaaaatccagaaatacaaaaggcaattagctataacagatttggtcactagtctttgatgttgttgcataatcattctatcagttaatttagttattaacataatagtctaactcagaagcatctcacggtaaggaaaaattttcctttctgatgaaatcaaatgtaaacactgtaacaaaaaaagaggacatttccaattatttaaaaaatggatacctcccactttttccaaaagtaaaaaaaaaaaagaatttggaatggcttaccaaacagattacaataaatcatagtctaagataaacacataaagggaaaccaccagtcaaataaagtaaagccagggatacttttaagcatggccaagattcaggaaaacaccgattatttaatgtgtactcaaacatcccatgaaacatgcatttgtgaaggttgacatacactacatcattcctttatttttgttatgaaagtcctgatgacccaaatggagaaagaatcactgcagtgaaagatcaattgtactcttgtcgtcaatggaacaaacccatcacatgttgcaaaatcacagattaaccacagaaattattatatactccatcaacagtcatccactgcctgtgacatgaaactcagggtcatgggagccaacactgtacctttcgactggggcgtggggtggccgtgaccggtccaggctgatctcctggggggctcatatggtaaatctgtaaagacaaataaattgactaaaagatcaatcatgtaatttttataagagatgctttggttttttatttgattttgtatttattagaataaactttgtgcaaaaaaatctggtaatccaaagaaatatcccactagatttgagttttatttacaaattaaaatttcatatattatagtggtctaaaattctcacccgtttgtctgaaaacttccattggcagattctcccagagctttccaactcttctaatttcctacaaccataagtcaagaccccaataaaagtttcttacaatctagttcatcctgcttccactgggactgatctacatctgtctctttattatcttcatgactcatccaaagcagagtctacaacttggatgaaccagcccatttttgtttgaggtctgttcctaaatcaatcaaatgacattcagcttctttttcttcttgcatctcctgggaagtgatcgctgccttatctttttatttgccagctgcctctcttagccaactcccattttccctttataatctcatcaatttatattaaatcagtcttatctgatctagtgattttcataggcaaatgtctcccatttctaatgttctaaataaatttagaatttctctaaaatgacctgcatgaaatgaattacaggactgaaatagtattgctcccacagcccattaatgatgaccttctgagcttaagcatatgccaaacatttctttgtatttataaagtcgtatcacttgtcctataaaccttcatttacttttcatatgcaaatttaataactatacttctgcatcctcagtgtgagttctattaatgattatcaaagctctatgtcatttcaagtttgtttcaaaaatatattacagaaaccttattataatactcttgctaagagtgcatagctaaggctatttctacatgcaatcttattacataactgtttcaaaattatgtcttcttggattgcttggtctcagttcaatgtcatgtgtcattctgggccaagtgaaggccatggccaaatatctcagcaggtactttgctgccagacaccaggagatgtgtacaaaatttcacttggagggtaggacaatgcaattgtttttaagcttctctttaaacaaatattttaattttgtttaaaaccagcaatttgatgggtcaatcttcaaagagcttgactgtgttgcagaagatgtgtctcttcctattttcatatcccaaagagaatagaaatgatgcgcaacgtgaaagtcaacacagaatctccttaatgtatttggtctgtttggctgcaagcatctttgctactagtgtggtctatgaaatcctacccttcagagctttggagaattagataatttttctttttaaactgatgttactcctctctctcagctggcatttttgcatttttggacgtaaatcttttcccacccagatcctcagattttcacatctcttgtgttggggttacacataggaattatatctgcagcccctaacaatttacaactgaacttcaacttaagtctctgggaacactctgcacatgggttctcagtcagttgcattttgtctaaaataaactggacagccagagtttcaatttgcaaattgtctcagaaagaaaaacctactcacaaggcaatcctagccacatctaacctaatttaggagcagaaaagcacattaactaaggccttctatttaccaaatgaaaaaaagcaagataatacagaaatacagaaatatgttctagatctctgtttctcaaagggtggtctgtggaccagcaacatcaacaatacctggtagcttgctagaaatgcagaatcttaccccagacctactgcatcaaaatcagcattttgtttattatctttttttttttttggaggtggagtctcgctctgtcccccaggctggagtgcagtggcgcgatctcggctcactgcaagctccacctcccaggttcacaccattctcctgcctcagcctcctgagtagctgggactacaggtgcctgccaccatgcctggctaatttttcgtatttttagtagagacagggtctcatgctgttagccaggatggtctcgctctcctgaccccgtgatccgcccgcctcagcctcctaaagtgctgggattacaggcgtgagccaccgcgcctggcctcagaatcagcattttaacaagatcctgggtgactctggtgcacactgaagtctgagaaagcctgctctagaccattgctcttttcaggaactctgttcctgcagatgatttcagaaatgctatctagagtgtgcaaagacaaactaaaaaatggttgaaagagttctagatggattgcttttacccatggcataagtatgctaatggaatgaatagacagcatcagtaggttagtcagatactaccttaaacataaaattgttgctcatgaaatgtgactgggaaaaaaaataaatgccgaactactattcccaaaatattttgaaactctttattcacaaaatccttcatatggtgtataaccatatcccatcctccctcgaaaataagtcgaaacttaacaccaaacagtctacttttcagccaagtatttgagacagttatatgaacaatgattcacatgttcataaacatattgccgcggaagataagtgggcttttgttttcttccatgacattctggtccaatgcttccttatcggctaccgatcacatgctgtgggcactaagtatccccctgtgggatatgacattgggaaacattcaactcaggctcactgagatgggggacagccaggggtgacttctttggcagctacaccatctcaaaaccttcgtagttctgctcttgactgcttgaaaaatcactcctctatgtatctttgctatgtgtcctttattgataatagagcatcagacttccaataagaatatattttacatttaattttcgctgatcatttcaacaccctctccatttctctttgactttgatcttcaaggcaatgaactcatatgcttggcagaagtgcccatgtaagggaaggctgctttctggcactggttctgttgttttatctgtaagagactgtgtttaaaaactgagctttatagaagtcattgcataggcagcttgggtgaacacagatgtacattacatcacaacagtataaaaaacagcatgaagctacaaatagggactcggctagtgctgaccactacacaccagcaactgtgtcgatttcctgggagctgggatcagcttctcattctgaatgagactcctcctccaccacacccttttgaagacatcactaaattaatacaacattctggctaccctttcctggagggctaagttcagccaagttttacattctcccttcatcaaactcactgaggaggaacgctctagctcttgccccacacaccccacaccgccaccccgctgcctacccgctttattttttaaagggcaagaatgtggatcgtggaagagctcatcctcattctgcaggatccacaccatatctgcaaagcaactctggaggttccctggctgggctggatgggaacagatgagatttgcctgctcttgaaattagatgctaatggggaacacaaattaggaagagcaagagctgctgctaagaaccaatctagaagtgtctgtgaaatgaaaaaaaaagtttgagtcaaccttaacataattaagttgctctctattttcctccagatcttcttaaaattctacatcaaagtttgagcatggagttttggaaacattttgcattcccttcttgcctaggtttgcatatccctgtggttatataagaactaagcggaagcaaagaatgcaattttagccatttgctaagatacaggctttacataacacctaactgagagatgctatgcagtagttgtattgtctcactatgcctagctgtgctgaaaagcactaggctgtgagctccaatggaggaataatttaagattccaagaaacccctgaagagcagcagcttcaaagtagaagcaaaggctgcatttgcaggcttaactctctaatctcttttgataacaccccagaggcatatcataatatatgggttgtcatggggatggaagaggaaaggatggggttgcagaacatcatccttgggatagaactgagcttttgcatgacctgctcctaagaggacaggcagggtggtgcactgtgtagttaataggggcttgcaagattctgtggatctgtttttgccactttttcccctgagacctcaaagggctatggctccaaaagaagtggattcagcaaaaaagaagggtgtttgtagaggaggtacagaaagggattctggtcgtagtaactgcaacaacgtgagaaacacgtgaaacatcataaaataaagtataataaaatatatatatatttaaaaaatcataaaaccacagaatgtaaaatgatatgcctatgggttgatactttatgagagtagagaagactgtctcaatgctaattcaacaaaggggttgtgaaagaaggtaaatcttgaatcaggaaaacgtgggaaaatactaggtacgggcatgcaaggaaaagggatgaggtttggacaaatggcaggtagtggtggtggcagggcatgttcacatgtggtcccctgtgaggtcagtgaacggcctcggccaattgtgcagggagactgaactgacacagcagcagcgagactgacctgacagggaagcagtcagggggctctggaataaatgatccacttgggaaggtgggccatgaacagaagaaaaggtagattgggggctgggcatggtggttcacgcctgtaatcccagcactttgggaggcagaggtgggcggatcacgaggtcaagagatcaagaccatcctgaccaatatggtgaaaccctatctctactaaaaatacaaaaattagctgggcatgatggcatgcgcctgtagccccagctactcgggaggctgaggcagaagaatcacttgaactcgggaggcagaggttgtggtgagccgagattgcaccactgcacttcagcctggcaacagagtgagactccatctcaaaaaaaaaaaaaaaaaaaaaagaagagaaaagaagataaaagaaaagaaaaggtaggttggggcagtaacccagggatgggtgactcacagtgggaagggaaggagggaagggtggtgaggaagtgctgggaaggtggatgcagcaggacaacacacatgtgtaggagtctctgcagaaagggtgcggaatgctgtctaatttaaccagtaaaccctgaacaccactgtctcctctatcagggactctataatgaaacggccaccatgcagagaagagacagattctggtctaagtagagttgttacctaggagcctggcttgcttcatggtcagcacaataacgctgaccagagttcggttccctcggatgtgggattagacaaagggtatggaaatgaagatcatggcacagcaaaccaagagtggaggagacagggatttgggtctgtatccccaaggaccttcaaagaaacagtcaacaatcacctttctgaaagtagtcaggtacccactgaccacagggatatcgtcagattcccagtgacctccctctggagctcgttcagctctgaaagttagtgatgcaaaagctcttccccctcagccatcacgacgttcattctccagttgcaggttcacagcttttatctccacaggagcagtcctttaaggttgatcgcttagcaatggatgacccgaggtgtataactagttcttatctccaagttcaagtccctgaatagggcctacagtaaatagtcctctggcttgttcagtctgctttaaattctttacaggtcagataccaatatttgtattggttctcataatcacagtagcagtggtcaaaacaggttatttcaggtacaaactgagtcgcgaaaacatacttgactagtagtggagctgtggaagtgtgctctctcccaggtcacgctcaaattatgggcccatggaagaccaccatcagagcggcatgggaggtgtctgagtttgccacccttgccttccctgggttgggcagagagggagtcccaaccaacatcctcacagtcaccctcttctccatccacctggatgggccataccttccaaatccaccatatcctaaaatgtgaaaacaaagcagctccaggacccactgtcttaaccaggtagcatcagtcagctggcttgtctgacagagagattgtgccaatgaatttggccagtgttgtgatcttttaacacagtttataatactagctcacaacccctggctttgcaactcagtcagaggcacctatgagatgtcttaacataaacaaacaaatacaaaattaaaaagtaaaaaaatttttaaaaccctagccaaatgttttggaaatagtttttatttttttagtttatatggaaatattttttaaatgctcacagaattacaaaatctctaaagcttgagtcaaacatgaatttctattttccactcgcaatacacgtggtggatgtctttaggaccaatcttgcagactctaggcactgggtcttgcccatgtttcaatggcctgtgaaatcttttacatgacagagatgacttactacctcttagtaccccttagctgctaagcctttccatcatgcttcccaggagcaagacagtaaactttttctctgacgttagagaagagaaaattgccagcctgaagtcactaggcagtaaccagggcagtgtcagtatttgaacagcctgagaagcttcctcattcattctctttagctccctgggcccccagtctttctcattagaaagaaagagtagttgccaagcctagatcttgaaccagttcgaactgagacttgtgtattccggatatgtgatagagtttaacatgaattctggaagcatgtatgaatatggagaaaccatcccaccaccctgaacacaatgtcatcagctgtgaggctggtacaatgatacctagcttatcgggctgatgtaagtcccagggagaggacaaatgctaaaggcaagctatacccttctgggaaatgccctctctccctgctcattattcgtctggcaaacatctaattcccctttgccatgtggccattcctctggaaagcatctttatgcctttcatgggggattgagttcctccccacccctgctcctacgccctgtattgctagaagtggttcctctaccataaaatctatcacattagggaaaacatttatgtgtacatatgtgtctctctggctctaggtcactctactgaaacatctagaactggaggcaaaacatttcggtttgttcaccatcataccatccgtggctggcacagaggaggcactcagcaaatgaacaaaccaagctgaatgaagaagtaaactttctgaagacaggaagcttactgaagcctggttcatctatatattcccagagtctaacaccacgcttggcactaatgggcacttgatagatgtttatttttgcatgaatggcatgtaaatttattacctaattaaatcatttggaggacaggcagtaagattcagatgtaaatactactggttgcatgcttctgctctgcaagactggcttcttgtgacatactgataatcggtcactgtgaatctggggagtgtccttgttttgtgctcttcccccgaggagggacagatccttctgttagttcaaaagtcggcctattcctaactgccaggcatccaggatgccttctttgcccatctgtctttctgaaaagctagttaaagggctaatctgctcttaattcctttagtgtggtctttgaatgaaatggtttgagtggatttagtctccaaatcaacagaggcagaataagactgtctgggactggcttcagctccgggatcagctctctttgtatcacgtgacttagggcacggatctcagcaggacatctgggatgtctctcaatgaagagatcacacaggggtgttttcgtacctggcctagttgtaattctttgcgtagcttcaggatatactgaagtatttgggaaaataaaagctgcaccccctgcagacaaaaggaaagacaaacatgtgaaggtcttttgttgtggttgtcgatctcaacatcagcgccaaatctacttttccctatgacaacaaagggaagagacctcctcaaacctgccttaacagagctccggagaaacagacaggtgcacctgtcagattctcaagatggaagtgaaacttggagccttggtgtactcctgtgccccgtttgctataaagcgttttgtgttttgattttataacttcttgatgaagccctatctgtgtccccctcaatcccacttcccactgggcaatctcgttttattaaaaaattatatggtacatgttttatttttcaacttgtataaaaacccataatatattttacagagcttttggaaagtagtatcaagcaattataagtatttagcctaagagtatatggattttattaataattaatccacatctctattcaaatgcattttccctctctctcttttgaccaaaactcatgctgttagctgagaaaattcccttttcatagttcagtccatttggaatttgttgtcttgttcattggtttcttccgtgtttaacaatagcaaaatttaatatatttggagcttttttgaaactttcactcaatggttaaagaactcataaataaatgtgaaattatcagaaaatgtgcatagctcaaaggtgtttcctaagaaggggaagtaacttcctctaagttatctgttatttctggccacaaggtcactaataggctgatgtgtgcaaccaaaattattgaaaaagtgtactaccaactcgaagcaggttttttaaaacttcagattaaaaagacaatgtgttgaatatagaagaccatgataaatgagcaatttcattgtaatactcaaaccgggactcactcacattttatattttaaaataaaatggtaaatattgggaaaattgcgtatttctatgtgagggctgatcgtgagttaactggctgacttgcaaggctttctggcacttcccgtctccctccctagcccgagtgattgtggagggtccctgcagctaacagagtggggtgagcagccggtggccatgcttccggaactctctccatcaggaaggagcagatggatgtgaaccaggaacacattcatccacagaaaacccagcctctgctgtgagcggggggcgagggaggaaggttagccaggatgaggcacggtgttaaaccctacttaggctcaggcaaaataaatacataactaagtcaaatgtagaggcaacggttagagatagaaaacaggcatttggttagtgactaatttcatattctccaaaattatagcagaggttccctctgaacaaaagctctcaaaatgttacagaaattccctcctgccttttgcaaacatacaaagtctgtaggaaaacaaatcaaatagcctaaaagtttattggaaaggaaaaagaaaattccaacttatcctagcaaatatttctttaagaataaaaatggaaaaaattaaaggaggttgctaagggcccttttatatcgaacatgcttttagtgtctacagagtcagcacagcgaatatattgggaccaacagaagaagactgtaatccggcaaatgtgagctaagttatggctaaaggcaaattctgcacgtctcctggttaaaaaggaaccctttgataatcaaagtggggtgcttgggaagcgctcagaaaaccaaagggcttcaccttcctttaggctgtggtacattcctaagtatccgaaagtattctgaatcatctacctgcgttctgtcttcctggcacgcgctgactggtttcccatgaaagcatgcaacctgtacgtaagaccctacgctcttgctgggaggcaggggcggggccagcattacctgtgtttctagcatgcattaaccgtggagagttttgtaaggctttatcaacatcatctgaagtcaaatgtggaagaggagctacaaaacaaaacaaaaagcgacatcaaaatgaaaaaaaaaagagagagagagaaagagaattacctttcttacaaaaaaaaaaaaaaaaaaagaaagaaaaagaaagaaagaaaaccgttcccccactcccacactaacatcatgggaagcttataactatttccagcaacctgctacttgttagcatgttaaaacctacatgggggcccgtctttaattcagggaagaagtggttgggatgccaggcaaagcaatggaggagaatttatccacctcactgtctgtcacactacttccttctcaccatgctggacgttgtagaaattaaagcatgcagcaaacattctggattcatgccaacatgccatccctttctgtcaggttaagccgaatcacatgatacaaagtgaaaacttcccttgttctgtgctcaggttagaatataaagtggggcttcatgtagctttagggagaataatccccctaattcctacgaaagagaagccttaatgattctatttcgattcggggtatcatggagacttaactaatgtgtgaccagttaacgcttcctttcccctttgacattccatcttcttggtcgcaggaccctggaggaggcagctgagtgttgaagtgaattttggcttctcctgagagcgctgactacttctcatcaggtgatgtggccagggtgttgctcccctaagtcatcacataccaagcatgtggctccctcggatccccagtgggaactgggcgagggcaggaggatgctgtcgacacacctggttgaaccctctgaagctcaggtcataagaaccatagccacagccatctatccttggaggaagggggagcttactctctctgaggtagtggagatgtgagagaaggatgtcggcgttgtagctgggggtgagcctctggaagtcgtccttggtcatcttgcacagttccttcccatcgatgttctggaataacaagatgttgacgtctggaaggccatattctttcaccgcccactccagccactgccgcacatggtctgtactccatagcgtaggatctgaaaggggtgggaacacattcagtcaattcctgaagccagggatcttcatcttggggtagatccccatccacgtgggatttctgaccagctgccttccacaagcacagcctccagccagcctccctggctacccaggagaacattttgggggaaagacaaaagctgcctcacatccatagatcattgtctttaaagtgaatagttctggaatcttgggattattcacatcacatgcccttgtttttgctcaatctaaagtttcctgtaggcataagattttaaaaattcttttttctcatttatgttcaattttatttatttattttaaaatgagtaagaataagaggaaacttcttttccttagaaaactactggtatatttatatatatttatatggaaataagagtaagccacacatatcaggaaggtgctaattacagatcacaacaacaacaaaaataataataacagtatttatgcaaaatactgaaaaatactgaccacagaatcggaaatgaaatatagatacaccaagactctagcccctcctatgagccagcgttcctcatagagagctgtcagttccagacttttcctgcagggtgtttggttttgcaattaaccagcacctgcaggagtggggttggtgagtggtttttgcattccacagctggccatggcgagcacaaacaccccacaggatgcaggccacgtcgtcacactccagtgctacctatgggacagggagagcagggcccgggggagaaggagcaggtgatctccaacagaaacgccagccgggatgtcctgtggtaaacaccctcagtggtagggtcttcagagtgtggtaaatggggcggctgctcccttgggccccgagccctgagagacacatgggcagggagttggagccctgagttctaatctcaccatttctccactttctggaccttgctgtgggcagctatttctcctttctgtgtctgtcccacctgtaaactaagagcactgatctcagttcccgggacaagcccttaggggtcaggcatgccaggatgttccagtcctcttgaatgaaagtcaggtgtgggagtcacattttagctaatactttcagatccttgtttgtttggtcccactaatattttaggctactcaagaatggagcatgtagtatgctgctgcaatacatttttaggtttgcagaggtaaaccgtaataatagtgagaaacagccagccagtcatacacccagagttctcttcctctccctccttccctcttccttccttcgcttctccctccctttcttcccttcagctacatagaagaaagaaattattgcaggtccagtagaatctacctttcccattccattctcctactgcaaacacctatcctgaagttagtagctagtggttagaagtaaccactatcctgaagttagtacgtgtatcactcctatacatattttaatatttttaccatttaaactacatatattgttttgtgtttttaaagttaacataaacgatatatgatttgctattggcactcaatgttataatttcaagatgtagccaaatgaattcacaaagatatactcaatcattaagcagctcttaggcctcccccatgtgaataatctcaatttatttagtgaatgtcccctgtccatctccatgcatacgcgtgaatgagtccgcattggtccagggcctggggtcctttctggaatcatctggggagactgaaaaactagtgatgcctggtctcccctgggagagtctgcttcaattaggctggagggcagttgggcatcacagttgataacagctcccccaggtgactctaatgagcagccaaggttcagatcatcttccctgggcctcactattccaagcgtggtcctccaaccgcggaagcatcagcatcacctgggagctaattagaaatgctgagtctcaggccccacccagacctgctgaaccagaatctacattttcacatgaaacctggggacacgctggccttggctgagtacctagatacgggatttctgagttacagggcacatccatcttcaacttgaccagctagcattggatgtctaccaatatttaaacacccacattctcacttaaaaatcagtgcacaggccaggcgcggtggctcacgcctgtaatcccagcactttgggaggccgaggcgggtggatcacgaggtcaggagatcgagaccatcctggctaacacagtgaaaccttgtctctactaaaaatacaaaaaaaaattagtcgggcatggtggcgggtgcctgtagtctcagctacttgggaggctgaggcaggaaaatggcatgaacccgggaggtggagcttgcagtgagccaagatcaggccactgcactccagcctgagcgacagagcgagactccatctcaaaaaaaaaaaaaaaaaaaaatcatcagtgcgcagaacctgaaaactaaagggaactctggttttgctacagagagaatatcaacaaaaactccaacggcagtgatgacagaaaagtgtacatatttatttgtcatccaaacacttggaaacatgttgttagtctgtgaaaactgaatgtagatatggaaggttaatgttatccagttcactgaagttcagatgactcttcgtcattggctgagaatttggctttcagagataaaatgtttcttttttcatgacatgtcagaattcctctttctacaaaaatggatcatactgaggtcttagggcaagttctctttacctttggttctgtgcagaggatagtttgttcagccctcacagagagaagaccccccatcctacccaagtcattccctgtaagttccatcctttgatgttagcgaaacccacctttttgttttgttttgctttgcttttaacaaaatgggaggactattttttttttaatgtaacaactgtacttcctagaaataagttcattctgggaacagactttcttctctaaatggtggaaccggatattctcaaaatgacacataaacatattgtctgaaagccactaggttcgtgttaaaatggtgaaaggagaagtttaatctctctattatcccttggtgtgccccttaattggtttcgctcatcaagacaagggttatcctggcccattcagttttcctttaagggaatcaggtgcaagaccccagagacaaagtcctcaacctgtattgtacttatctctacaagtctcactttgagttggtaaaaggctgttctggagttccggagttctgccaatatgagtataaattactacagcctttctgatgaacaacacaataatacaacaatacaacacaacaatacaatcaaacgtctttaaatatgtgcagattccctggcttaaaaattccatttctagaaatttatcctaaggaaataatagaggatgtgcgcaatgatttattgtcaaggatgttctttgtagtgttgtttataatagcaaaacattggaaacaccctaaatgtccagcaaaagagaagcagttttgtaatgcatttaggaatgttcctgtgatatttagagactaaaaattacactgttgaaatatatttattgatatgataaaatgttcaaagtagattgcattttaaagtttcaaaatattattatgatatcattgtattttgcaaagatatataaatatctgcacagaaagaaattcagagggagatacagcaaaacgtgaactgttgtcactgagggaaaggagatggggaattttagatttgtcattttcactaaactatattttctcatttttctataataaatatggaatacttgggttacaaattatttatacaaaatgtattctctatttttcaaagccaaaacatggtcttacaaaaggtatatatatatttaatgtatattatatgtatactatatatcacctatatataatatatgtgaaagtatttttataaaatactttaaatactttataaaaagtattttttaaaagtataaaaaataaaagtaaaaaaacaaaaagaaaagttaaaaaaatgaaactatgcaaagcattttataaaaagtataaaaaataaaactactaaaatactttataaaaatatttttataaaataataaaatatataatatatatagaatatatacttacatatatgctatatatactacctatatatagtatatatgtgaaagtatttttataaaattgctgtcaagagtataaaaagttaagtttcagtttcttttatattttgttaatatagactgcttcatctgaaaagagtaaaattacatgaagtcagaacactcccacatccttttagcatttgatctccacacctctgccctataaatttctaagcaaacaatggtgaaaacaaaacatggccactcggtagaagaaatgagggcattccttttctcctgagcactcgcaccactctcccagacccactccggaggtgttgcaatagaggacagtttgcaggggaaaaacccagattccccagcatgaagcacacagtcctttgttccatgggtgtcattcccaaccattccccctccaccctacatttcctgagccaatgcctccatgcctgtgccacatgccacccacagcgtgaaggactagcaccttcttgtgccctcacctacactcacgacctcctttgggcatctgtcctagatgttctcacagaggaaacacttaacaaatctctgggcagtgaagtgataacaagactgaagacctagtctctgctcacactgaactccacctccactactttggccaggcaatgatgctgcagctgtagatgatggtttttagagttcaggtcagtgcactgggtccaggctgtcaggttttggtcctaaccttttaactccatgaagagccccagtagtctctctagtctcctccacactccatggtatctcagcaaagctttatggcttctgtcacaccaggaatcaaagaaaggggctcatgagttcctatgagattcagcaggcctgtcttcctcctttcttgaccccaaccacacatgtgtaggaggaaggggaggggactacagcataagccccagccgaggcatcacctttgcctatgtttaggtgcgaccttctgccctaggtaggaacacctcttgtctccaggtagcagtgtgtttggaacctgtcatttaattttataactggacctcatttttctcttctgtaaaacaatgtggagaatttcaggacctgagaaatgactcgaataggataagaactaagatagatttaattcaagtaaaagtcattaagcattatgcatatggctatatgcaccagtactatggagattccaaagtgtccaagaccaagagaaacactaaggacccactgagagaggcagcttatgaccacaaccacaaagcagaactaagtctctgtgatcaggctgggcgtggtggctcatacctgtaatcccagcactttgggaggccaaggcgggtggatcacctgaggtgaagggtttgagaccagcctgaccaacatggagaaacctcatctctactaaaaatacaaaattagccgggtgtggtggcgcatgcctgtaatgccagctactcaggaggctgaggcaggagaattgcttgaatccaggaggcagaggttgcgataagccgagattgcgccattgcactccagaagcctgggcaacaagagcgaaactccgtctcataaaaaaaaaaaaaaaaaaaaaaagactccgtgatccaaggaggaagtggaagtgcagagaggtagcaccaaccaggaaaaatgggaaaggcttaccaggagagtgaacttggattaacagcgaggattttgacagaagtagagagaagctctttggtttaggggaaccacttagcccagcctcatccgacatgggcatgaaatatctgacatgtttaagaaaaagggagaaatttggtgtggctgcagtggaggatttcagagagagcacagcaacatacgaggatggggatgaaagctgggctcagatcaacaaggtccttgagtcttgctaacaaggttggattttcatttttagagatttcagagtaattgaaaatttctaagaaatttttaaaaatcttaaataacaccaatcacagaaaacttggtgatgaaaataaaaggctttattgggaatccaaatacccacattgggattcttattcaaccatttactggacgtaaacgtcaacctctctggaatttgttttatatttttctgtgggtaattaaatgaaatgttaggggaatagaaaagtaaatgagataatggatgtgaaagcactttgccaacaataacatactgcaaaaaaagaatgcatccacacactcgattttgcattgcaaactctgctaaaatggaataagaacaaaatctgttatcacaggggcagcctcctccttaagacacaaaagtccaatttataattttattttaagaaacttttggagatgcttctgtcagatgaatcataagccattgaagataagttgttcattttcagccttccattccaattgttttgaaaacatctgtgtcatcattctacatgtcatggacaccaaaatggtaaactgtcatggcacaggctaaacagaagccatcactctctgaagcctcttatttgtatcttaagttacatggttattatgaaatctactttggtaaattggaatttaaaaaacaaataaaagtaaaccattacacacagagttctggagttgtactgttaatgtactctgtatgtggagtgggagtgggggtataagcagtgggagggagggaggaaggctgacatttaaaaaaaatatttccatgaaacaggattctgacctagtagagttcccctgttgccaggaaaatattgagtagatatttaaatcaggcaaaggggcactgcatcgccaaagacaaactgtgcctttgtgaaacaaaatgcctcacacaggcaaacatcttctttcagaggcccctctagagaaatgaataaagtaagattaaataaaagccaaactggtgataatgaaagtcctgaatgttatttttcttaaataatatcaacgtaaaatattggcttcccaaaagaaaaaaattactcttggttatgaaaaaaacatcaaaaaataaaaactaaaatgtacctctaagccatatcacaagcctagtgaggtgtttgtttataaatccaggccctgggcaagtcagccaatctgctgtccaagacactcataagcctgcaaaaataagatttaacatcttgcatcctcaggaggacagaagttacatttataaagcaggcccaatagagagaactggcttaaatttgagcaatgattcactccatcacaaatggaaatttgatctcaaataaagagcctacctcaagactgtttctgagccttttaaatttctaacttatatgtagagttcatttattgttttggtattgatttctaattttattgcacgttggccagtgaatagagtctgtatgaaattaacattttattttattttatttttttgagatagtgtctcgctctgtcacctaggctggagagcagtggcatgatctgggctcactgcaacctctgcctcccaggttcaactgcctcagcctcccgaataggtgggattacaggcacccaccaccatcgtggctaatttttgtatttttaatagagatggggtttcaccatgttgtccaggctgatctggaactcctgaccttaggtgatccacccacctcggcctcccaaagtgctgggattgcaggcgtgagccaccatgcccagctgaaattagctttttaaaaagttccggtttgttactcttttggcggcctagtgcatggtcagtttttataaatgttccttgattgcttaagaaatgcatattctctaatttgggagtacagagttctagaaaaaaaactcttggtaaggtgtatttaattttaatgtcactgacctatcaattactgagaaatgcaaattaaaatatctcactaaattggacttgactatttctttttgcagttcattacatatttcaaggctatgttattaggtacatgtaagtttatcattattatatatttgtcatgaatttagccttttttcactatgtaatgaccctcaattatctccagttatgctttctgcctgaaagtatatttagtctgctttctatttctatttttgtcagctttttaaaaattcaattttcactagcgtatcttattctgtcaactctcaatctttgtttgtgcaagatttttttgtaaacaacccataactgattgtggagtattttttagtctagtctatcactctctgtctttaatggcaaatttggtctatctacacttattatcactgatctatctgatttttaccatcttattttgtgctttatgttaaactttcttagtccattctctatttctccttgccaagtgtctaatcagattgatctacttttcttcattcacttttttttctttgtttctgtattggttttgctctttgacattctagttctctttcctgttaatctttaaacaaaatctaagtttaattaccagtaatttagaaagcttatacttgaatcatccatctctgattttacatgacaatgttccctcatatttttactccactgaattttctactccctacttagggaggctgtggttgtcattttacagccatttctttctagatctaccctcaccttaatcaatttcattgctcccatttccttcctgtatctcactcccttcttctaggatccattttttaaattaaatcttttgttattatctgaagtgaggttcaattagcaacaaactctctttttaactccttcttttatgttcttccttaatatttaaaaagtttatttattttatactctttatccaatactttaattatttaaccttctgcttaatcatgttcattgtttctgttaaatcttggttgggggagatctctcttcagctatttttttgtaatttgcgggtggcagagtcatctttagcgggtctctatctgcaggaattctgtacagcgtaggttgaagacatgtctctccatgaagatttcgtatttacttctgccaggtttcccagattatcactagcccatgaccatttttctgtattaatttctcagccttagagttcctggcacacactgttgtgtgtatggggtggggactcgggtaatgacaggctcagttccaattctctgctttgtggaagctcaagatttcattccttgcccctagttgacctttaaaacccaaatctctgcattatagcaacctaggacaaccaggtgtcaacataagaatgtgctgctctgctctattctcacttttttccttattttagtccctaaggagttcattgcctttcttcccagttcagctgtgcatttaaaaggatgttaaactccatgcagcaattccaggtgttttgcaaaaggaatgtttctcaggtccttttatagtaacctctctattttactagaaccaagagccctctctgcatactttttacctatttactttgaatagttttcatttttaatgcagccatcatcctaactcatgttatgctttacttcattcatttattaattaatcaattgtcaaaaattacttatatgaattgtataatcctctatgaaagattcaaaaatggcaagaaagagtgcctgtcctctacttgtttgagaatctacaattctgtgtattttatttaaaaatacatgactaaattatttttgttaggctctaaacatagctttgtcattctgacacactgatttatttctctggatgaaaccattctcaagtaatcatcttgtttttggataatgatcgttattgttctttgttttcttttgttgttgttgcctcctgttattccatgacaacattgtgtgtgctcatcatgttttagaaatgcaatggcttgttccacataaaggtttctccctgcctgggttttctttctttgtcttctctttaaatgttgctatccccagagtttcatccttggtctacccctctcctctctccatatgtatctttgggcattcttatttgctctcatgtttgaactataacatgcatgctgtattattttcctagggctgccgtaaccaagtaccacaaaatgtgtggcttagaaacaacagaaattcatcgtctcatagttctggaggatcaaagtctgaaatcaaggtatcagcaaggccttgctccatccgagactgtggataaaatctgtccttggctcttctagcttctggtgctgtccagcaattgaatgttccattgcttgcagttgcatcagtccaacctctgcctgtcttcacatggagttctccctctgtgtttccatatcatcttccctctgtgtgtgtctatgtccaaatttctcctttgtgtaaggacaccagtcattttattaggctcaccctaatgacctcatcttaacttgattaaatctgcaaaacctctatttccacataaggtcacattctaaggaactgggggttaggacttcagcatatcttgtgagggaggcacaattttttaacctgtaacaggcagctgtttctgccagtctatatcttgagtccccagggcactctcacagatgccagacccaaatataaacagaagaactgcactttttatcccaggtactgtttaagcatgtcacacatattgctatatttaatccatatagcaccacatgaagtaggaattattatcatccatattttggtgatgaaaaacctgagaaacagcaagattaagtagcttcccagatcccacagttagtacatggcagagtttagaactcaagtgctgtgactcccgatcaaggactttccatcctgagctctaggcccaccacactgcctgacaggtgtcccagaagcatcttaaacacaggatgaaccaaactgaaatcacctattttaaacattttttttttgtatattcattaacacctacccagctgctcatgctaaatctaagctgtcttcaattccattcttctctttgactttcaagaaaaacagataacatcattagcactgtagaaatgtaaaaattagccctgggcaacacagtagattattttacaaaattccctctccacctcctttgtttacttaagtcttatttgaaaaggctgttgcagaatgtctacaacaatttaacaaacacattctctcatcccattcctgtgttctcccctgggtatttttgtcagcacagcttaggaagaagaacccagactgtggagtcagaaagaactgggttcgaatcctggctcttcaaatgattggctgtgacatatttggcaactctcttagcgttcctagttttagtttctttactgtcgagtgagaatgataatgagtacctacatcatagggtggtcgcatgatttaaatgagataatgccttttctacaaagtgcatgtccaagtgcctgacaacagtgcatatcaatagatagtagctgtcgttgctttttagaaaaatgacttgattttagcctcacatttaacccaatggtggtttcctcaaccgctattcagctgataactttaaaatacacataataaactttgatgttagcatttctattttagtgggttttgttatttagttgtttgagcatagcaggaatttaaacagaagattaaagaagcatgtcccatcatatcgacagagtggaagagatcctcgggtgtgttcagggacgtaacaaagaaagatgaagacacaagtcatttcaccagcaggttctgggcctgagaataggctctggtctcacccagttgtgcaagtgttcccgggaaagtcatttcacctctctcagtcttggttttctcatgtttaaaggaagactgaacttagaccaccaagaatcctgcaacccctgcgagtctgcgattcctgctagttagatctagattactgttaacttgataaatcacatttactctcctccacacagaatccaagtgctggctgtgttgtctggcgattgagaacacaaaagacatgatcatcacctcactaaacttacaatctaatagaacagacaggcttataaataactcacgctaagaggattggaaacataatatatcagccatcagggcttggtcggagggtatgttctattacttgttattcactggctttcaaagcccagtgggggaatgtcaatatttagggaggatcatgtggaaactatgcagtcctctaacactctgagaactcaagatcccttctttacatgaaatcagactgccaaagactcatgctgggtgtctgtcctctacctgtgctgagctattctctaatgtaactcagcgctcacagaagatgtcacaagaaataagctgttgaaatgcagtgctgcaactgtggcaggaagacggtcgatggtcaggtctatggccccagtggccccaaaagggatccttcttttaggattctacactatgataaacattgccttccctgtgaaacttcttttttgaaaggaaaaattatttccccaaataactcttttcattttggctgccaggaagctcaaagccatactagaaacttaagtacagcatcttgggcaagcttgtggtcaaaatggctgcattcttccctcacatgctcttggcttctcatttgtatttttaactgccttagcactgattcctaatttccatttgataagtcaattgggtataagcccatcagtagtttagttcacacggcacctcaaatcctttgcagaatatccacatttaagtaagtatatacatgcatttgagaatacaatatgaaacaaaataaagtatgataacaaaataattggtaagatgtcataagaggagtgattaatttgccagaggatcaagcatggctcccttgacagggcagattttgaagatgtctggaagaatgagcaagagcattccagagagggaaccgcagggacaaggacaccgggtggtgaaaatgcagcgcgtgagttggggatgtggcagaggaaaacggcagaggctgcaaagggctttcgaaatcacatcatcgtgggtataaatgaagctgttcttgattcgtcctgtcatagcaatctccattcctcacatgctctgaaatactggtctgagtcattcatttgagctctcaatcacaccttctcctgtctgtcaaaaactacttaccccacatgggtgggtcttagctacttctgacagccttcggtcatctcctcagtgattaagagtaatgggaactccatgaacactttctaacggaatagaaaggtcctagcacaggggtctgagtaagacacaagtcatgtagcttcagccacacatgtttggtgggcaagaaaaggtgattttaaatctcattagagcttttattcacggtgaatggaacacagtaagagtttaatgaatgaattaataatgaagaaagtgaagagatacagtgaagagaagaatgtggctactcttatctctgagattactgattattgcaagggtctatgctgaaagtgaattattttaaaaatagaagcagaggcatttgaaaaactcaacactttagcacctattttaaggaattaaaacagaaaaagaggccaggcccggtggctcacgcctgtaatcccagcactttgggtgaccgaggtgggtggatcatctgaggtcaggagtttgagaccagccttgccaacatggtgaaaccccgtctctactacaaatacaaaaattagctggctgtggtggcaggcgcctgagatcccagctactcaggaggctgaggcaggagaattgcttgaacccaggagacagaggttgcagtaagccgtgaccgcgccattgcactccagcctgggcaacagagcgaggctccatctcaaaataaataaataaataaaaaataataataaaaaaacagaaaaagagaaatctttcaaaatgctataagctgctaaagcgagaggtcctattgcattttggtcagcattttgcaacttttaagaagtgaatggagcctgtgccttcctctttgttagccacttggttagcacatctccatgttcacagccaacacctaaagagtaacagtaactactgcaatgagtgattcttcatttttttttggaatgttaatgtgatactgttaatcatttctatctttcctttttgtctacttgccttttctaaaagtgataaaccatatctttattaaaaataattcaagtctattaaagtaaaatttatatcttctatctagattagaacttttcaaccttattgtacatgaaaattacatacacaataagcatgttaataatgtaaaatttccaaccccacacccaggtttggaacatttggaagtgtgtgtgtgtgtgtgtgtgtgtgtgtgtgtctgggaaagggtctcactctggcttcctggtgggagtgaagtggtgcaatcatggttcactgcagcctcaaacttctgggctcaaagaatcctcccgcctcagtctcccaagtagctgggactacaggaaccaccactacacctggctaatgttaaaattttttgtagaaatggggtcccactatgttgtccaggctggtcttgaactccttggcctcccaaagtgctgggattacaggtgtaagccactgtgactggcaggaaatgtgtatttttaatcataaattttccaggtaatcttgatacaagtggttctgaccatactttgaaaaacactttctaggccaggcgtggtggttcatgcctgtaatcccagcactttgggaggccgaggtgggcggatcacctgaggtcaggagtttgagaccagcctggcaaacatggcgaaaccccatctctactaaaaatacaaaaattagcctggcgtggtggcgggcgcctgtaatcccagctactcaggaggctgaggcaggagaatcacttgaacctgggaggcagaggttgcagtgagctgagatcctgccattgcaattcagtctggggaacaagagcgagactttgtctcaaaaaaaaaaaaaaaaaaaaaaagaaagaaagaaaaagaaaaacactttctagtcaacctccaaattaagctcggccaaaaaagagccatgtaaccagcatgggggatgtcacacttgtcaggcccctcttattacaactggtttcactgaatgacacttgggtttacgacagtgtaagagactgccctgccctatgagagatcctcctagatttacagatactcgcaccaaatacatagataaaaaccagagatgggaattatggcctaaccagtaccctttgggaaggcacaatcaacagtcttgccagaacaacaggcacaaaccagggctgcccagaatgcctggtggcgctactggttgaatgctttgctcatgactccccttatcttccttaggacaaacagaggaacacatcttcctccagactcagaattaatagctggaccatcttttcacatttgctttctttttatcctgtaggcactgaattatccctttcatactgcctgatgatacctcgaagccaaataacacctaccttttgcaattctgcaatatttaaatgttgcaattaaaaatacacatacacacacacacacgtgcgtgtaaacctcactcctggttttactctctctgttcaatttttactttagtccattctccacattcctttatttttaaaaagtggattctaccgtgctctttcatatgtatctatgtgagctttcttaaatctgttctgaaataggaggcagtgtaaatatatcaagtgacagtctacatttatccttcagggacattttctagttgacactttcttatgggcttttttttgacactttttttatgggcttctttattaactcaagatcatgagtatcaaaaccagggttgagggaatcgcttctcaaaagtgggttccaggtaccagaacccaatctgaacacggacaaagccccccagctcctctgtggttttatctctcagtctccgtacagtacaaatttcctcatcagtgtttattagggccactgctatctctagtgtgtaaacatcggcatgtattgatgatggtacaaatgtttaggaataactgatggtttttttttttttcactcagctatccgtgtgatttgcattagtgccaagcaatgtctctaagtagtaaggtctatgtgaaccactcaggaccaggtctggagaattctttttgcacacatggggtactccgtgccccaaatctgccttagtgaggtgcctggataccatggggatggatacagcagctggtacagctgcctgaggtcctgcaacctcatggccacattggaaaattgtccagattgtgcaatgaagctgtgtgtgtgtgtgcgtgtgtgtgtgtgtgtgttcatctctgtgtgtgtatgagcacacatacatgaagcttgaccaataactgaaagactcacaacttgcaaaatcagccacaactagctctcttacaaacactattaactgaataactgcctacactggcgtgaagcaactgaaggagggaagagctgaagagaagagtactttgctccaaagaaaggaaacagccttcacatcaaagcttactataagccaatttgcagagctatccttgcatccatccagctaatatttgatgagcagctactatgtataaaaaatcctgggtgctctgacttcagttgattctctgttctcttccccacacaaatatctctcttattttctaaatactttccttagtgtagaaagactcaagtctggccctactgaaaaggatatttatgacatcaaagcatattgatggcctcatggaaatacagcctcaccagttagaagatggtaccaggcattacctcttacatctgtgattcaatgaggaaccaagcaaggaatcttcagtgcaggccccctcagatggattctctcatctttgagatctaaacactttgttttgtctcctttgaagaaattacattcttaaggaggagggcaaagggtgagatgggttagggggcttcctttgggtgtctacttcactttgttcatgcccagagagtgtctgggcaacacaccactgccctcctgcctctcctccaggcacatcctagccttcgagtttttcttatgtgccacacatctggagtgggcacctgggacatttgtgtttctatttttcccatccaacaggaacagccccctgttctgaggcacagcagcaagtgaggcagtctcaggcattcaggtgcattgtcaagatcaaaccaaatgcatggcctctgtacctgtcaactgcctttcagtaaatactaaggacggttttctccctttcgtaatctaccatcagtgtctcctgtaagtcttaaaaaatgctttgaaatcaggcacaaccccaaaggatggtccctttcacaccccactgcatcgaaccagctttacgtgtttgctgaaagtcacatggtgacagatctaagctgaaacctgggattcaaatccaggccagatgttttgcaaagtaccctgcactcctgaactcttctgtctagaaggtgacagaagcccactgggcatgatccaactcaggtaaagggaaagtcacaccatggagggaatctaacctgtttgccatcacacttcgcagatattaatttaggtgaccccaggagcaagggagaattgagtttgtgcagatttcacccatgcatgcccttggctactttgccaacaaggagtaacttgtacagtgcagctcagtggtgaggtgtccgttcatccattctccacctcccttaatattcactgagcacctcccacttaccaggcactgcaactggccctggagatagggcctttgtggggcttatgttccattcagggaagaggataataagaaaactttttatttttttatttttattattttgagacggagtcttgctcttgtcgcccaggctggagtgcaatggcacaattttggctcactgcaacctctgcctctctggttcaagcgattctcctgcctcagcctcccaaagtgctgggattacaggtgtgagccaccatggctggccagtaagaaaacttttacataaacatgcaatataatggcagaagggaatgaatgaaatcaagaaaaatcaggccaacaggagactggcagtcacaggtggagacgagagcaattccagacggaagtgctcaggactggcctccctgaggccatgacattggcacggatacttggtgaaggaaaatgatatggaactacctggaattaagggtttcaggctgagctgacgccaaattcaaatccctgaggcaggaccgcagggtgaccagatggctgaaacaagtaacaggagggaacccacagaaattgctgtaagcagctgagatttaatccaatgccaacaggcagagactaaaggagtaaggcagacctgcctgagtcctaacttggcctcttattagcctaatgcccttggaaaagttggtggacctctctgaacttcatcttcctcatcagggaaatcatgagaaagatgtccatttgcaaagattgcttgagatcacgtttctaaagcatttatccaaatgcctcctgtagggtaaaggttcactgactggtgactgttgctgttgttcttatatttctggctttaggtagcatgtatcctctgaggagctttaagtcattttttctattacctttagtttggctaaataaataagttcttgtcacgtctttcaagttcaagagctattcctttgggttggttttgaattatgtttgtggtaaagagttactctggttattagaatctgtattacaggccagtgatagctggaattttagatgcttaagggaacacgtaagacagccatataatatatggctcccacatgtttatttttccagataagagaattttaaaaacaaacaagtctatcatctatcataaatagtacctcatgaaggacaggatatttggaacaataatctccaagaagtggcaattcctccctagaaaggtcacctttcatagacatatacacacgtgtgcatatgtgtgtgcacacaagcaaggctgcatgtttgcctggacatcctctttctctctgtctctctccatacgtagtgtgtgtgtgtgtgtgtgtgtgtgtgtgtgtgtgtgtgtatttttctctatgtggcaaaataaagagctggggctacatactgctgtctcacatattttttaaatatttgtatttttaaatacaggtgtatttttcttgctttgctgtcgatccgtgaacatgtcctcatgcatagacctctgccagctcccatttacaagccctgctctggacaaaggagatgtgatcaatgccacaggtgggggagaagagctccctgaggctcagcctagccttggggaagttgcgatctgccgagggcagtgaagctgtgggcacctgacctgctggcacgataactctgcgctcgttcgtggtcatgtttgggggtggcatgtgcttctcctccatgtagctgccgtagttcatcccaacggtgtctgggctgcccaccatcttcccgcctttggccacactgcattcatcaggagagttcctggaggagaagaaatattcttccattataacagcaatcaaagagcatgtctccatcgacttctcacaatacacagagagaaccaaagaagggcaaggcggaagagactgggggagaaaggacaagtgtgaaaagccaaatacaggcggggtgccgtggctcatgcctgtagtcccaacactttgggatgccgaggtgggcggatcatgaggtcaagagatccagaccatcctggccaacatggtgaaaccccgtctctactaaaaatacaaaaattagctgggcatgcctgtagtcccagctactcaggaggctgaggcaggaaaattgcttgaatccgggaggtggaggttgcagtgagctgagatcatgccactgcactccagactggcgacagagtaagattccatctcaaaacaaaaaagaaaagaaaagaaaagaaatgccgaaaacaggccttgccttctgtcctcccgaaatgcatattttgaagccctaactcccaatgtgatgatattaggagagagagcctttgggaggtaatttcagtttgatgaggtcatgagggtagagtcccacgatgggattagtgcccttattagaaaagaaagagaccagagctcgagctctctctctctctctctctctctctctctctctctctgccatgtaagggcagagcaagaaggtggccaggccatctgcaacccaaggacagagacctcaccagagactggccctgctggtgtctgattttagacttccaacctccagaagtatgcaagctcgagtcccattgtttcagccagccagtctgtggggctctgtgaaggcagcctgcacaggctaggacagtgcccatactggctagatgcacagaacacgcacaagggaggcggaactaccacctggcttctgtttcttaagcagctcctcctgaaactgtcatgtcaaaactccatctgtgacaactgattggggacacttgcagggaacagtgaactgctctttgttctcgcggtgtgacagcaaacaggcagagtagacagatgctgtggggcggcaccagggacactcgctgctcagtgaggtttatcctggaacgacgttccttctcaaaacctcagaatgaaatcctcctgctcaatttcaaatccctgcagccaatctttacatatggagctttgaagactcacagtgttccaggcttaggtgtagacaggaagggcagggaagggtgaggactgacgctaggggaggcctcatggggagtggactccagcagtcctagaggacccttgggaaagggatagggaaggaactgtgtggatgcagagaggggtcagctactgactactgaccgtgggcaacaggtcacagggctgctgttagtaaggcagtcactgtcatttggataaagtcaaacctacctttctggaaaaagaaaaggaaaacattttaaacagtgagttgtgaaagctacaggacattggtgaaatcgcatctgatagggaaatgctaaaaagaaaatccagcttagggccaggagtggtggctcacacctgtaatcccagcattttgggaggccgaggtgggcagatcacctgaggtcaggagttcaagaccagcctgatcaacatggagaaacccagtctttactaaaaatacaaaattagctgggcaagtggtggtgcatgcctttaatctcagctactcgggaggctgaggcaggagaatcccttgaacctgggaggttgaggtcgtggtgagctgagatggcgccattgcactccagcctgggcaacatgagtgaaactccatcaaaaaaagaagaaaggaaagaaagaaagaaagagagagagaaagagagagaaagaaaagagagagaaaatccagcttaagcagaaaacagaaaatacatgtcagtgccttcttagatggttaacacgtagatggtaaacccagggtcactgtagctgagaagtattaatatttagggtctgttgtctaaggcggatttccagaaatgcctctcaggctctatccaatgcatacatttttttcatattccttggaatctgggaaccttcgctttctctagattttagatttctatcccagtgtttctggttgtgggatccacgccaatgaagcctcatttatctcctccacttcttgttagttggagttctgcagagaacttggacaatcaaaaaactatgggcttggcatggatgtgaacttcaagtctaaggaggtcaaaaccatctgaggcaggagcgcactttctgagtggggtgagatggagaaggtcattccacacctgaaagccatagctgggatgtggacaggaagggaaagtgtttgttcagcatgtgggaacttgaaaatataggtttgttctcagcatcacttacaaatgtgtctgaagcctatggagggatcttaggtgttggcagtgaagagggtacactgccatctgcggatggaggttacagtcagggtcacgcaggactcaggccctaacatgggcctggaatgcacagccctgcctgatggcatcctcacagctgtgctaacatgaaggaaattttaaaataataatggtctgagttcccatgaagtagatcctgaatatttccaccgctgcctacacatgcattatttcctcttgatgctatttttcctggcttcacacatttatctctaaaagacccatcctaatatgaaaacacagagtgtcttcacttagactgagtttcctattcctctggaaaattccatcagttgagtagagtgtatatgttttggtatatttgtctcaaggagagaagttaccagggaagagaagttagagggattaggttctttaggaaaaagactttgcccagatgatgtgagtaactcaagtaacaactataaaatctagacaacctttgttcagattcaatcattcactcatccatttagacagctgttatcaagtgccggccgtataccaggtcccatcaattctttcttctccaacaacgcagttaacaatttgaaaagtaaaagatcaaagagatgtataaaattatagaaacaggccaggtgtggtgactcacgcctgtaatcccagcactttgggaggccgagctgggcggatcacctgaggtcgggagtttgagaccagcctgaccaacatggaaaaaccctgtctctacttaaaaaaaaaaattagccgggcgtggtggtgcatgcccgtaatcccagctactcgggaggctgaggcaggagaatcgcttgaaccagggaggcggaggttgcggtgagccaagaccacgccattgcaccccagcctgggcaacaagagcaagactccatgtcaaaaaaaaaaagaattatagaaacaggggacattgaggattttgaacccttcagaccaacccctttttcattttcttttagttctttctagtttaattttcatatccgaggacaagaactctaggcatagatcacaagagtttctctgtgacattaaagtagatccttcaggctggttgcggcagctcatgcctgtaatctcagcactttgggaggctgaggcaggcagatcacttgaggctaagtgttcgagaccagcctggcctcccaagtagctggcattacaggcgcctgccaccacgcctggctgatttttgtatttttagtagagacggggtttcaccatgttggccaggctggtctcgaactcctgacctaaggtgatccttctgccttggcttcccaaggtgctgggattacaggcgtgagccacttcacccaggtttctcttgcaaattttaacagcaaaagagtagccttaacatgtttgggatctgttttgggagcttaatagttatcagtcttcaccacagcgaactgtgttgctggcattgtctccactttccagaggtgtgaactgagtactcaaaacacaaggggctggctccaggactcacagccaggaggaggtagaatgagacttcagtgcgggtggcccgaactctccatccctgcttcttaaccctgaacagaatgactccacaaagtaaaggcaagacaatgtcttttcaaaggtaactagatcttcatttcaggaaggcatcagggactccctgacccatacactactctggtttaaggtgtacactaaagcactcatcctgacatactctcctaccctgggactgttcattccctgaaaagcatgtgcatgacacaaacagggcacatatacaagatgcaaataagaaagaggagtgattcctggagaagaaaagaattttcagagatatctgctttacttaagaaaaggacgccaggcacagtggctcacgcatataatcccagcattttgggaggccaagataggtgaattgttttagctcaggagttcaagaccagcctggacaacatgaaaaatgtgtttacaaaaaatacaaaaattagtcgggcatggtgtgcacctgtagtcccagctactcaggaggctcaggtgggaggatcacctgagcctggggaggttgagactgcagtgagctgagatcatgctactgcactgcagcctggacaacagagcaaaaccgtgtctcaaaaaaaaaacaaaagagagaaaaaaagaaaaggaaattttatcacaattcagagaactgaaaagtgttcatttgaaagtctcactataaatacatttctagctctgtgcccaagaaaagatccacactgcacaaatgtgtgtcttgattactccactgcaaccccaccttcaccaggcattccgaggctcacacatcgccgggaaaaagttcccgcaaacagcttggtatgtcacctgcaccaagcgctgcccagcatagaggaccacgtgttctccattctcacatgataaggatttggacgttcaatgcattgttttattgtgcacatgacaaagagtatgctgtgcagggaatgaacagtcctgaagtaggacagtgtgtcaggatgagtgctgcaatgtacactttaaaccagagtagtgtatgggtcagggagtccctgatgccttcctgaaatgaagactagttaccttttaaacatacacatacttttaaacatacacatacttgcatatgtgtgttgcagcagttcctgagaatattctcaggctattcagcaggtgcctgtcaaacagataatcatttagtaaatattaaatgtatctgtctttttgtttggggtggaaatttctttattgcaaataagcgtggttcaagatattgctctcacagactcctttgaggacaaacaaaaatcattttgtctttttatttaatttaaatagttttgggggaacaggtggtgtctggttacacgaataagttctttagtggtgatttctgagattttgttgcacccatcacccaagcagtaaacactgtacccagtgtgcaatcttttctccctcacccactcccatgcttcccccagagtccccaaagtccactgtatcattcttatgcttttgtgtcctcatagcttagcttctagttataagtgagaacacacaatatttggttttccattcctgagttacttcggttagaataatggtctccaactccatccaagttgctgcaaatgccattttcttccttttcatgggtgcatagtattccatggtgtgtgtgtgtatatacacacacgcatatatacacatatacccacacatatacatatgtatatatgtacatatacacatatatgtatatctacatatgcacacatatacatatataatatgtacacatatacatatatatgtacacatatacacatgtacatacgcacatataaacatgtgtgtatacatgtatacacgtgtacacatgtacatatacacatatgtgtatatacatgtatgcacatgtacatatatacatatgtgtatatacatgtatgcacatgtacatatatacatatgtgtatatgtacatgtatacacatgtacatatatacatatgtgtatatgtacatgtatacacatgtacatatatacatatgtgtatatatacatgtatacacatgtacatatatacatatatgtgtatatatgtatatatgtgtgtatacatgtatatgtgtgtgcatatatgtctatatatatgtgtgtatatatatatacacacacacacacacaccacattttctttatccactcattggttgatgggcatttaggctggttccacatttttgcaattgcgaattgtgctgctataaacatgcatgcgcaagtgtctttttcatttcctctgggtagataaccagtggtgggattgctggatcaaatggtagttttacttctaattttccatactgttttccacagtggttgtactagttccatagtggttgtactagtttccatgctgttttccatagtggttgtactagtttacattcccattggcagtgtaaaagtgttcccttttcaccatatccatgccaacatctattttttttttatttttaatgatggccattcttgcaggagtaaaatggtatcaccctgtggtcttgatttgcatttccctgataacaagtgatgttgagtgttttttcatgtttgttggccatttgtatttcttcttttgagaattgtctattcatgtccttaacccattttttgatgaaattatttatttttttcttgctgatttgtttgagttgtcgattctggatattagtcctttgtcaaatgcatagtttgcaaatattttcttccactctgtgggttgtctgtttgctgattatttcttttgctgtgaagaaagtttttggtttaactaagtcccatctatttatctttgtttttgttgcatttgcttttggattcttggtcatgaactgttattctcaaatttacattttcagttccaggttctatttgtcacccacagacattagtcttgacagtcctatgcaatatgtggcatcaacaagagtaaacaggagctgggaagacagatacttccctctgctcacagcagcagaaattccacattagccagggggccccaagaggtggggggctggttcagaattctgagaaagaactgaacaatagcccaatggctgggatattaaaaagccagccataacacctcacaactccctagcaacacccttggggccacacagcctcaaactcctgagctcaagcaatcctccttggttcagcctccctatgaatagctgggactacaggccacactccttgaggagtgtaacctctgcagcaatctcacacttttccatggcatttggtcataactgtggtcactcacaggaacacagaaatagtgtaggaagacaaccaaacattcatgatggaaataaaaaaaaccagaatgctggtgtccttcttctagtaactggagacgtgcccaatgaaactggcttgttgagcttcaaacaataatctcccttaaacagcagttggagaattaagttctaatcatttaaaatcatgagcactgacttcttaaaacatactagtattctgaattaatgagaaaaggacacggcaaagaatatcaaatacattggaaattttgttaaatttgagttaaggagagaaggcagacacgttgctaagcccagttgggttctcatagggttactgaatcagagggctggaagaagccccattttcaagcccccagacatgactgtctggaaaccacttggatgaacaagagtttagcttcgttaacagttttttagggaggggcttcgtaattttcctctgcaactccagagttctatttataaatatgtatagtggttttaaatagccattattcccctacctgtgtgcaagctatgtgaagtttggggtggcttataaaaatacatataagacaaaatgataacataaataattaacagaataaaaatgaggaaacaagggccaaaaaggaattaagagatgaaagcagcccactgagtaagcttactatttatcctgctgaggtaggataccaattcaactctgagctttctactagccaaagcaaagacacaagtgcatctgatgacaaggtttgaggtattaataagctacatacaaaccagttattcagcagaaataaagctctccctgggttaagctttgagagtttttctcggggcttctcatgaagaaaactggattatgcagtaaacaatatcgttcccaacatctcataatacatctaagaccatcccgcaccgtgccaggcgtagctggtggcagagcaggacgctccctgcacacagtgctcacatgctgcagccacagaggatgagagacggcatgtccccagcctctcctccttactggctgccattggaaagatcagacctgtcagagaagtcaatgcaaaaacatgaaaaaaacgtgtaattaaaaaaggagaaaaccttgagagatgcagtgttatacatgcctctagtttcataactcccaaatttctagatttgatttgattttattgttttttaagagacagggtcttgctctgtcacccaggctggagtacagaggtatgattatagctcactgcagtctcaaactcctgggctcaagcgatcctcttgcctcagcctcccaagtagttgggactacaggcacgtgccaccacacccagctgttttttaattatttgtatagatggggtctcactatgttgcccaggctggcctctaactcctgtcctcaagcaatcctcccacctcagcctccccaagaactgggattgcaggcatgagctgctgcactgaaacccctaatttctagattttaaattcaaatttaccaacactaaatagggtcatgtttatgtctcccaagagcaccaaatgcactgtgggtaaacaactctttccaggcctcagttggttaatcttccaaccagtatttcactgttgactaatgatgagcatggctccagactctttccacgtgtttatgttataataaacatatggataaagcatttaacatggtgcctggcacatgaccacgccaggtgtcagctattgctgttagttcatttcatctgcacatctccatgacagaaatactcgaaagcaggagccttgttacagatgaagcacagagaggttggataacttgcccaagatcacacagccagtagtggaagaattgggatttgaacctagatagtcatggtctcgactccaagtacttcaccgccccactctatgcccttgcttggtaaatccgtgtgaggagtctttcatagacctaaagcaccattgaatggatcctcagaaaacttaatttcatcactattaagtattctaaaagaacatcttcagagtggccctgaagacagtcatggatgagggttacagacgtgagctgagcagggcagccacgaaggagcaaggcagggccccgtgggagacttggaaggtggcaatgtttatgtagagatataaataggttttgataagtttggtctaaaagaaatagtcatctcaatttgcagttaagcgttctatgcttctccccaaaacttcattgctgtgcccagcagggtgcatgttttacacagatgatgggcaaacattcttaagtgcaaaaggaaaccagacaaaaagtccccatgacgagacagccgagtgggagtgcatctgactctgactgcaggcccaaaaagatggaggtgaggaccaggacaggagctggaccactggggaagcagtcaatctaattttttaagattaaataaaataagtccaagatgaaagcctccttgagctgtcgtccatacataataccccttaaacaaaaaaaaagcggggttggtggtggggactaatattactgaaaaaacatactgagaaatgtaaaatttggtctttagtctttgaaaaacaaaataaacttggcatctgactttggttttctcacatcagagtctacttacagcgaggcaatttccgtcatggaaagaacccgcaatgaaatggcacagccgtggccattagcttgacaagcatggagcctcagcccttgtgagtgtgaatgggcctcatttatccaagaacggcactgaatacatcccagaggggcagccccaagctcgctggccacattaaatctgattcaccctcacttcagaacacttagcaggggcccactccttggagaaagtccaaggcaagtcagaatgtaattgcggaaatcaatatgtcttcttctttgagtcagtggaggcaaacccgctaatcctgtcgaaaatctacctattcttctagagccatcctccttcctaatcctctgaattcctcttgcacctggacacgactttccaaccccttgttctccatcacatgctggtgaaatgtccccgaactcttccaaagctttctccctcctgctaccagagtgctctcccccaaacagaaatgcaagctgcccatgtccaacctaacccccatcatggcccagagcccctccctagattctcctcagtgatctggctctggagcccctcaattcactcatttgtttagcaaatatctgtggagcatctttctaggccaagcactgccccaggtactggagttatatcagtgtctctattaacatggggctggcatttgagtagccaaagcccctctccccaactccatgtgctctgtgctcaaagaccacattccacatcaccccctagtctcttcccttcaggccttcacttttgctactccctctgccttcaaggcctatgaccacctgatacctgccctattcacctgttcaccacctggtacctgctctattcacctgtccatgctcacctctaggttctctacaagcctttcctgggccgccagagaggaatgtctcccttccaattgcaccattctctgtattttctcagtaagtgtctgcaggatgagtgagtacatttatgaatgaatcttccatttaaatattgagttccttatctcatacctgcagtgcaagagaaagcccctcgtgttgcagtcagaaaaccattgctgaccttggttgaccttagatgggtcacctaacctttcgaggctcaactccttcattcataaaaatgaatggatgctttcttgaggttgctgtgaggacatccctgagatgatgcctgtgaagaaagtctgcaaactgtgaagcactatacagattaacacagcaacatactgcatgtgcatggctgtgcatgcgtgtatgtgggtgtaaatgtgaggctttttgttcttggcaactgttcataactgtacctcggtgaactcttaggtaggtcaggaagctaaggtttactattgtgcagtgttcagcatgcaactgctttttggaatgtcactgtctttctgaatgttccttttggtttattaggttagttcacattaagaagaacttggtgaggaagccacatggaagaaatggaaaggctttctttggcagctctaccctaagagggcaaaggggtcagttctgcgagagaacccccacaaggaggctggcccgggacaagcattccaggcctgtctcaagtctgaatacaaataaatcccttctcaggtggttttcttcataaggatcctaaaagcatatacttagtcctaatcgactgagcaagctcctaatcaagtttcatagtgtgaatcggaggtcagtcaccacaaaaggtatttttaggaccccagacaaggaggggattgtctggagcgctgcagggtaatttgtgggtctgttttatttctgaatcagaggcagtggaaaagctgtttcagaccccatggctggagcagcgggtggagctcagcagtgattcatgtagaactccgggctcaaactgaaaccgtagatgtttgtcttcacagctgtgtgttatttttacccttactaaatattctctcttacacctggaatttcagcctcttcccaacagtcctgttccctcccccttccctgaagcagttgaagacaaaattaattaaaaagtcaccaccagctcaccaacagttagttctttgtccccttaaaggggctcgatgtttccctgagaaagtttcattatttaagtttatatttctctttacagccaaaaacgaatgccagcaagaccgtgttgcttttagatcttgaaaactggagggaaatgcaccattttgggattcatcatttgaaaacaaaatgttctgtagcataagatctctacaagcagttacatgacaaagatcagatgtgacatcttttctatcttgtgcacgtcttttaatttgtctgaaagactcctttttcagagaagaaaggattgagcccaatagccagtatggtgcttcatgtttttataacaggccaggtgaatcctggtaaccaaaacaattttactttctttttttcttttttttttttttttgagacggagttttgctcttgttgcctaggctggagtgcaatggcgcgatctcagctcactgcaacctccgcccccactgggttcaagcgattctcccgcctcagcctccgggattataggcacctggctaattttttttttaatatatatttttagtagagatggggtttcaccatgttggccaggctggtctcgaactcctgacccacctattatttttaaaatgtgattgttttggaaacacctggtgaggttaatgtaaaggtgagtgcaggtgaactgacctgatgtgataaagtaagatagtaataaatgtttctaaaatgtgtaacatatacaaaaaatcaaaatgcagttggcacttggatttggtgcatcttgtcactgcttgtctgacacgtggagagaaccttgctatccctctcaatgcaggaaagacgttcagcttcttctaagaagccctgagggagtgaagaagagtccaggcctgtggtcaaatggccaactttcactttcactaactttcacttgagcaagtgacgaaaacttttggaaactcagtggtcatccgtaaatgtgaataatcataataatgtcatctcatagatgtttgagaaaactggacaatatgttgtataccaaaatctattaataaatcatgtgggttttagaaatatgggttaatattatccctttcagggtctttttctcctgcccaggtagagttgatggtaccctcatatctgttattgctgggccctgaacatcgctctgtactgaatgtgtcttatgatctcacagaatctttttcacctttggtagaccatgagctcctcttagttccttttttttttctttctctcttttttttttttgagacagagtcttgctctgtcactggagtgcagtgccgtgatctcagctcattgcaacctctgcctcccaggttcaagtgattctcctgtctcagcctcctgagtagctgggactacaggcacctgccaccatgcccagctaacttctgtattttttgtagagatgggggtttcaccatgttggccaggctggtcttgaactcctgacctcaagtgatctgcccacctcagcctcccaaagtgctgggattacaagtgtgagccacctgcacccggccagcttcacttaattcttaatccatctccatcgaagctaacacagtccatgatgcagattaaacactaaatacacgttggtttcctgcagcatttgtcaacttcgacactagtgccactcggagccaggtcactctttggacaggtgggggtgggggctgcaggggcgctgccctgtgtactgcaggatgtccccggcctctacccaccagacaccagtaacacctcccagctgtgaccagcagaaacacgagcattggcaaatgcctctgggggccacatcacgatggttgagaaccactgggctaatgaattaagatccactgagctcaggcaaggaggcaagagcctcttgttttacctggtgtttattagagagaagttcctgtccccagtgtctggggtgatgcttaaaaggggcccttaaaggggcctctatgctcatgaggattcctagttatggtttgtccgtaccttgtttggggtacattccccaagccttggcccatcctcgcttcctcttttcctcatgccatatgtccaacccatcagcaaagcacgttaattccaccttccaactatacccaggatgcgactgcctctcccaccctcccttgctaccactctcacccactctcacgcagatgtctcccatcctacacccacattttctcaggaagacttcaacacaggagccagagaggccctgcaaaatctaagtaacactatatccctcctttgcctcaagtcccctaatgatttctgaactcaccagaaagtgaaagtcaaagtccggcaatggccccacgggctctccaaactcatcatctattactcttcttcttggacactaaacagcagccacgatggcctgcttgttgtcctcgaacacctcaagctgacctcagggcctttgcatttagcattccctcctcttggaatattttctgctgtttaatcacgggcattctccctcaactgcctttgcagctttactcaaacatcacttttttgtgatcttctccagccaccttctttagagctgccatccgcttcacgtctttatttttctccttagcatttaccatgatctaacctgctgtgttttcataagtggtctgatgtcatgaccatcttcactgctagaaagtgaacttagtgaggcaaaacttttttgtatattttatcactctatcccaagagactaggaaagtaggtgctcaataaatattcattgaatgaatgaatgactccacgcataaacagtatgtctaaggccctgatggacccagcagatactccctactttttctcatctccatcacatgacaaatggcatgttttttaaataacatctataaaacatcctgctatctgacccgaggctggagttattcatggcatgcaatgaatctatcccagagagaggcaaggcccagatagcattgtctctcgctgcacaggcccagctgggcaaagcgccaatgtggcgggagggaaggaggtatttctcaactcaggcaaggacttctggggaacaaccccacctccgcgtagatcctcccagatcattcgctgggtgggtcacctttacccagctgctgggctttctcatttttcatctccttggatcgtgcaacagagcagtggttctcagactaccaggcatcggaatcccgcagagggctccttcaaacacagcgtgctgggctgccacccaggtctcttccgattctagggcagggcctaagaagccgcatctcaaacaagctcccaggtggaggtgatgctgctggtcccggagcccacgctgagaatcaccacaccgggggaaccctcactcaacagaatcaaacatggcaatggctccaggtggcctgcagactgggctgaggggggactcacagcatggcacataaattgactgagttccacctgcagtgagcctccaggtgggcttcacgaaatcgccatcgcctgtggaaaggggaaggtgccacttagtgtaagctgcctgtgatctggctggcctgagctggggatgctcagatggaggaaaagcagcctgctctgcacagacctgccagcctgctcacgagaagacagtttgcttgtggaccatgagtgagcaggtgttacctcttggcttatcctgctagtctatcatgacttgagctttggggacctcacagcaaattcagggcattggtagggagctcacgagaggctgagcaggcgctgaaactcccagccaggcccttggtgtggatggcacaggaaaacagctggttttagtttggccacacactgacagttctccattgtgtgaacacttggggctttctggtgcgtgaggctagagtgaagaaagggagagggtggctgtggaccaccgaagctgaaaaatgatgtcctgtgtctacacaacgtgcaattagattactgtctgcaagaatgctgctgtttgatctggcagtggccaagccaaacccacaaggacatcccagttggctcgcaaagcagtggttcctttctctcctgtttttcttttattatgctttacagaaactctattataatggcaacagatctcgtttcaccacttgtatttcatttcaggagcttgtaagcacgttaggactgaggttttgtagaattccactattcggttgggaactaagtccttcctttctctcaaagcacatggcctttttctccgtgggtactggatggatagggatggacagagggcactattcccaagctgggtattctaggcagaaggaggtgggccatgttctggaaagacctaagctgcagagagtgcacttctcccgtggaggtgtctgcaagatagtcaggggccacaaaggtaacagcccacaagttctagccaaagagtaatatttgacttacgtaacttccccttggacttgacttcaagtggcatgtgcactacaggaaagcccattatgcataagctaagaggagggacaattagaagaagctattgggccaggggccaggagatgggctaactccctggcacagctggcctggggcttccgagtctggaaggatgcaggtgcaggtagtggagcgttgaggagctgcactcctggcggggctcctccagaggcaggcagccacacactgctctgcagcatctcatctgtgagcccctccgtggcagaatctgcgtctccgtgaaccctgcctctgccctggcccctcgagctgggctgacacagcccggtgctggttcacggtgtccaaaataaagcagagtgaatcacgcccatgttcccttttatggagctgcacctgacattcgtaaagagcccatagtgaggccgggcatggtggctcacgcttgtaatcccagcactttgggaggctgaggcgggtggatcacctgaggtaaggagttcgagaccagcctggacaacatggtgaagccccatctccgctaaaaatatgaaaactagccactcgggaggctgaggcaggagaatcgcttgaactcgggaggcagaggttgcagtgagccgagattgtgccattgcattccagcctgggtgacaagagcaaaactgtctcaaaaaaaaaaaaaaaaaaaaaaaaaagcccacagtgagtcagcaaagcctgcggatgggatcccaggcagtcctttgtctgccccaaggctgcctccaacctctggctgagatgagtcttagctccactgataactgttcagctttcttttcccccattccccttcaggaagcccgttggattgttaatagcagaacactgactcaccacttatgtttcaattctttcagatcactgagcttgagcagccccctagtgaacctctgacctgacacgccaccccctttaccacccgctgtccagtcaggctgagctccagcagcagcggtgaactggccccccagagcacactggtttggagatctaaaaagtacaatgggtcaccagtcactgatgagtgcagcatccctggaagtcaggtgtgggggtcagtttcctgtgtcaacttggccaggccgtagcacccagtgacttaatcaaatgctaactgaggttgtactgggaaggcatttgcacaggtagctagtcagttgaacttgactaaaggagatgatgtcagataatgtgagtgggccttgtctaatcagttgaaggccttaagaacaaagcctgcggtttccagagcagaagaaattctgcctactttccagcctgccagcctcccctgcagatctcagacctgcccactcccacaactgcattagccaattccttcaaataaatatcttaaaatgtaaaaatatcctataagttctatttctctagagaatcccaactgatacaccaggccagcacccagacacaatgccaggagacacactgagctctgggggagacgggcatgagctctgtatctttctcttctacaaaggggattagtgtcagccactcctctccctccccctggaacatccttgtgggtaggggacgatgacacttggtgactggttgacatctgtacattgctagatgcctcaaagcggaggcagcctctgcagccagtgttcctcccctgcctattacaacccagctgcccttttcctcaaaggaggcacgtaggcctggattgaaggcagatgaggtccaccttgttcccttcatgaacagcacctgccaaaccgacatcaccgaacccaccggaggacccggaggatgaagaggatgacatgatggtcttcactcggtatccacccaccaaaacacatcaccgatgctttaggagctggaacagcattgaaagtttatgacggcagcaatctgggcaatgttagaattctatgagccctgagagaggaactcttaaagttcccattgtttccttgaaagaaaatgtcaaggccgggcgcggtggctaacacctgtaatcccagcaatctgagaggccaagatgggtggattgagttcgagaccagcctggccaacatggtgaaaccccatctctactaaaaatacaaaatttagccaggcatggtggcggatgcctgtaatcccagctactcaggaggctgaggcaggggagtcgcttgaaccccggggggtggaggttgcagtaagctgagatcgtgccacttccctgcagcctgggtaaaaaagagcaaaactccatctaaaagaaaaataaaaaagaaagaaaatgtccagttcccctgaaaaagatgtttcccggaaagagaccctcagcgcagcaccagcctttcacttgcctgacagaaaaaccacccaagagctttccccagtctgctgcgctgagggccctggggcggaactgccctggtgtctttcttatggactgaagctcctggtgtctttctttcttatagactgtagccccttgcctggggctcagggttaccccaaactcccaacctgtacccctggggtcacaacacaggctggaaaagcttccccatgcctggccaggagggagaggagacatcagctaccaaggggcatcacaggctcacactaaggaaaacagtgtttgcacttctcccacaaacagaatgcttatttttttattttttatttttatttttttgagatggagtttctctctgtcgcccaggctggagtgcagtggcgcgatctcggctcactgcaagctccgcctcccgggttcatgccattctcctgcctcagcctcccgagtagctgggactacaggtgcccaccaccacgcccggctaattttttgtatttttagtagagacagggtttcaccatgttagccaggatggtctcgatctcttgacctcgtgatccacccgccttggcctcccagagtgctgggattacaggcgtgagccactgcgcccggccagaatgcttattttattttaaattcgggagtaacacagtgagaacaatagaaactttcatttctggagcactgttctcgcctcctcactcagtctcccttcggaggcttgctgaatccagactggccccaggccagactctcaaacaagggccaggacatggctcactctgcctgttgtccatcggaaatcatctcagtgcccttttgtctgagatgtttccttcctctctccccaccttccaacatccccctcctccctgcaggtgaattgctcataggtagaaattagcctctgcagaagaaaagctttagaaatgtgtcccggtcttagtgtctccgccgtgatcacgctggcatatatgggatcatatgaccccacccaaaacagaattcattcagtgtttccaggctgtgttccaccaactgatctactgcataaacactgctgcattctttagaacatgattaccctgcattcttctgtgtttcagaaatatatatagttaatgatcaacagaaacattgtatcaaatgcataggatttatgggtaaaaaatatttacatgtaatcattaatttcccacaactttggtgtcctggacccatcattgcattttctatccaggtccttctgtaactccaggaatgaatctcttgatgagattcaaaaatatttacatgtaatcattaatttcccacaactttggtgtcctggacccatcattgcattttctacccaggtccttctgtaactccaggaatgaatctcctgatgagattcaagatgggcctgcctcgagttccacttaaaggaccagtgcggtggcaatatgtagcatcagagccagtgcactttcaagaagcagatgcacagacgcaaactgacttctcagagtggaggagtgttctggcatctcccatctccccatctggcacgtccagccttgccgttgacattccctctaggacactgtgacttggcaccttcattaacaccacactaggaattgacgcaaccgtttccagacttataaactatgacacttataataaacctttttagcgttaaaacatatatgtaacaaaaaggccccattacagcttcaacagagtggaaaatgctcagggtgtggagtcaaacactcctggtttaaatccaaactctgattccatttaagtggtgatttggggtcagactggaaatgcctgatcacaggtttcttcatccatcaaatggggtcaagtatacttcatgaggggctgctcggaggactgaggggctactggatataaaagggctttgtacacagtaaagtttccgaaaatgtgagctgttcttatgacctgatggtagattatgcaacatttcgaagaaataatctgttctttatcctaagatttgatattctttttcctgaatatatatggggtattagatcataattgaaattaattttacttttcaaaactacacagaattcaacactttttgagggccagggacagttctgcatttggtaatacattttacgtgacagttgtatgttcatgacaaactcagggaagctaataattatgggagacactggagagggctttatgtgtaagctaagaggaggaaaaaaaaaaaaaacaaacagcaggcattaagagaagaggaccgcagagatcagagggtggggtgagggtggagggcagacaatggagatccactagcaaattcaagtggcttggacatacgccgcactgcctggccactagctgacactctccctttgtgaaaacataagacggcattattttccaggcaatcaaacctcagatgaattctgccatatgtgggcaaggctcccctcccacagagccctcgtgcctgggaaatagaattgaacacatcttcaaagagagttcttggtaaatatactactaattttacaaactccatcctctacacaaaccactggagaacacattttcccagcgctgtccaacgtcaccgttcaatggcctttctttctttctttcttcttctttttttttttttttttttgttagccagagtcttgctctgtcgcccaggctggagtgcagtggcatgatcccggctcactgcaacctctgcctcctggattcaagtgattctcctgcctcaggctcccgagtagctgggattacaggcacagtggccttgctttctaagtcaatctttagagaagcatgactgacttccactttgcctttgcaaaggataggaaaatgggaggtcagggagagaaaggggcggaagtctccttaccttgagccattcacctggctagggttacattccattttgatggtgaccctggctgggggttgagacagccaatcctgctgagggacgcgtgggctcatcttggaagtctgtccatagtcgctggaggaggacgcggtcatctctgtcttagccaggtgtggcgttccgtaggcacactcaaacaacgactggtcctcactcacaactgataaggcttcctgaatgcccaaagaaacacataattcaagacactccaacagacagtcatgtttcaaaaagttgttgatttcagagtcctttctaactgggaccacattttagatcgtttttatggtctccatttctacctttcagaagaaaaaagtagcttgtttttctttcctcgggacagtaagagttagaaatgccagcctagaaaaacttttatgcaggtctcgaagcatcccaggcttgactgtggcagggcagcagaatatccactttaatctcaacttaaggaagttgaatttcaaaggtcttagaagacatccaattgcatgtgtcactatttgacaaatgcaatctataattcaagcagacagggtacagagcggtcatgaggattaaaaaaaagaaatctgaaggccaacacctaagcatctggcaaaattgccacattcctggggattttgcggaagagggacttagaggaagacagagggatcaatggagcaccaaagggcaaccaaccaaagatacaaacgtttccactctaagttattagccgaagtacagtttcaagtggtgcttccatgatggtgagcatctggatgataaatgaaccaaaaaaaaaaaaaaaaaaaaaaaaaaagctgtgaagtatccagatgcttccaaacagcaggatgtttaaaatatctggatcactgacaagctcttttttccccttactttcaattaatatcttcgctcttttgcatgatttggtgagaagaaatagcaatttgtcattgttggatcaatcatttttcgtggttttaagtcaaacaagtggttagccaatggctatgtttatattctacagccaatgagcaacggcaagtttgggaaatttcaacgacttaaatgatggcttgtgctgcaatgacacagagctgttgtgatacaatccaattttggttcttataacagacaaaaagaattccacatgaatgctcatttttatattagtcctttggcatcctcagtattgacatcaactagtgagaagcaaaggctagttgggccacacatttttatttaaaaaaaaagaaaaagaaaagaactttggaggcagagcaggggaggcaggggagtgtgggctgcgcagacccttccagtccaaacttgtcatctccaaatgagaaatctgagacccagaaaggtctagagctaatcttgaatgagctggccatgatcaaccaggggattagtgatgggaatgacttgtgtattaccatctgccttctccttgcccccacagccctatgatgccctttgtgacatttttttcctttgggacatgtgtttaaattagcaccctcttccccttctctgagatgacctttacataaataagggtgcttcccatcagtaatcacaccctagaagcagcccttctgagatggagagcttcctctccacccagaaggatcagaatttttaggaaacaatcacccccaactccacatctactctgtcgctcgatcctccacctgtcccaggaccaagttttttccttagcttcccaagtgcacaaacttctttgccagacacacggcactgagaatcagcaaggaggaagaatcaaaacaaactcaaacctctgtctctcaaagtggtggtcaggtgtctgtgctaaagcaaaagcccccatcctggactccataagtatctgtagaattacagccctgtgacaccctgggaaagactaagcctgctgtccaaacagtaatgcaaaatgtaccaaagagtcaggtaggccagacagagaaccagaatcaggcacaagggaaaaaagtcatcttgaatagacagcaaaatcaaactcatcaacaaccaaaaatgatacgaggcagtgacacagaagttgacagtacagaaacggcatcctagatgttagggaacctgaaattcatggctttctcttccagtcacaattgagtggccaaaacaaggaatctaaacacatagatgtgggtttcaaagtaaaatcagcaccatagacttagtcatgctaattaagacaaaaattagaccttattaaaaaatttttgcaaaacagatactcccttcccatggtggcactggctagtgtgttttacaggctcagaacaggaaacagagctgatggctgctgcctctctccttcctgggcctgagactcgaccaaggctcgcaggggaataacacactatgtaatgttagctttggctcacccatgatgagaaacatgaacaaatgtgtgatttatatcagaaattggcgaaaacaggttatatatataagaaacaggctaaatttaaaattacaaactaaaaaggaaatggctgcaacaataacaaacaagcaataactttaaagtattagtatttctccaagataaagtaagcttacttctgcaaacaaagccaatagccacaaaaatgtagtgtaagtttgaataataaaaaaaagaccaaaatattagaactaaaatgaagcttaagtgtgtgtttgtaggggaaggaatccattctcacatctggcaaagcattatttcagcacatggttttctaaagaaagaaatcaaagttaattgagatcgatttaggaaggaaaaaaccctcagaaatgctagagatgggggaggcatgcctcctttttttgcatcttaaaattcttctcacagctaatattgcacaaaaatgaggaagggaatataattcagaatattgaaagcaacccctcagttgcttttgttcattagaagggaaaaattctgaaaataaggaagcttcaggataaacacttcaaaagaggtgaaatacagtccacattttgaaaagacagagcaacccaaactatgccccaaagactttgttgattgtcactcaacaaaggctgctgaacacctaggatgaagtacagctcaggaaaaggaaacaaatgaataaagaaaatctctctcacatacacattttgggagtaagaagaagctgaggggttttcacagacccattcccacaacagcggtcactaaagttaagtgctgctcttcagaagcaaaccaaggcacagccctgccacatctttgtcctcccacttgacttggctgttggcaggtttcatcatcccttcggttaaagcttgaatggacacacgctgctgcatagggccctccctgcctggcagccctgtgacttcaaaggggagagaggatctagcccagtaggattaaaaccagaaaaagagtgctgaacacaggctgctaatcaggaccacatgagttctttaactccagctctgggagagacttcctggccttgactgacatgtctctccttccctgcagcctggctcctcctctttataactagcagatctcacctacctacttacctgcctgcctacctgccggccaaggtaggcagctgccttagttagcatgtatagattgttattgcagaaactctggccagccacaaggcttgggatctgcttcagtggctttataacagagaatattttaaacgtcaaaatctggcagatatgtggcataatcatttcatatgcctgcttctatgttactataaaaagacctgaactttagattggtgtttgccaatgtgtggggtgtttttttctgtagctccaggaaagttgggatattcccatcaggcaaatggcaggctaccaagctcatttttaaataacttacgagaaacacataattctaagcaaattacccccaaacaaaaggtactactgtgttagtactgtagtattgattatttcatttcaatacggaatataccaataacacatgaggaccattcctttggattttggtcatgggataacagttccagaaatgaagggaggtcccaccaggttatatttcatattataactctaaaatatgcatctattttcaagtaactagagtacaaaaaaggatccaaaatacattagaacactgaaaaagaaaactaacaaagttgaatgcatactgacattttcagcaaagtatttcaggaatcctgatgcctttctataacagatgaatactttgcaagatgcctatttctcaaccaaagtattagaaaataaaggcccaaaattgattctaatttgtgatccttatagctcataaaaatattacattgttaatacagagaatccatcatacttaacctcttttgaaaatttgggagtggtaaagtgttgaaactgagaaaatctttaagaatggtcaggtgaatttcacatctggagtaagcaaaggcatccatggtcctttcgtggttttcaaaaattaggaagatggccagaactaggcctctcgagaattggattatcaaacccaccttcaatgttttcaagtcttatatgctataattatttgataattatgaaaaacaaatggaacaactaagtggaacaagaattgtatgatcatgatcatgcttaaaaaaaaaaaaatcttggttcgggcatggtggctcacccctgtaatccaagcactttgagaggccaaggtgggtgggtcatgagttcaggagatcgagaccatacaaaaatccaaaaaaaaaacaaagaaaaaaaaatagccaggcgtgatggtgggcgcctgtagtcccagctactcaagagggtgaggcaggagaattgcttgaacccgggaagcggaggttgcagtgagccgggatcacgcgactgcactccagccgaggtgacagagtgagactccatctcaaaaaaataaaataaaataagaaataaaaaataaaaaaatcttaaagaagtccttgctgctatcacaacacagtgtggagatcattcacttaggaagccagcatcatcttcaatcaatagcctactttttctgtcagttttaatcccattacaatccaatacaaaacccttccttaaatttccctcacatataaccacgcagaatttggtacatcacttaactccctatattgccatcttttaaccactttcataaatagcttatccaccaaataaaccaggttaccttaagcactttcatgcaatatcctcttaaattctattttgttgattacaagatacaccacttgtcacattttatcagctctgaaatatgaaaatgaaaggcttatcctaggtatcaggcagcatttcttcttctctgatggcagataaaataatgggacattttatatccaatgacatcttacattttatgaaaaatgatcatttaatccttacaattgtcctataaggtcagctgtgattcttgcccacccatcagaaagtgcgattagagaagtaacatcaacagtgaggatgaggcagaaacagggtttgtgtctgtgaatggaatcattccccaaggctgtagactggccactacctggctgttactggaaggaagaagttggattaagaaaagtcacacggtggagtgttttggtgcctgctcttgccatgagagatggaatcacctagagagagacagagagagagaggctggtagagggaagagacagaagaaagatgaagggataagtgtccagaatccctggatctgggatggaataaaggatctggatggtaaacggagagtgctgggaaccagtaaggacttctctaggtataccatgctcttctatgagcctaggggatgtgtagcaatgggccctgcatacagttaatcatttcttttgcaatggcttaaatcaacaaccttgttcttttctttgattaatcagattattcagacacaaagacatggccaggtgttgggatgtgttcattgcaggtggatgcctgccttctcttaatgagtactatgcaggaaaactaggacaggtaggagtaccatttataaatatgctggagcctatgccactttgggcggcctttagtggatgtctgcagacctaaggatattggaaatctatctattaggctgtcgcaggctctattgtttatagtttctcttcaaggcagcacatatgcagtagatgcttctaaaaggtctagtatctaattgtatttggaggaggaaaaaacaacacaaacaaaatagacaatgcacttagagaaagctctgctctcccaccataagcctgacaaagatactccagtccttcaggagtttttattctaaatgtgtgcacttttgcaattctgatgccaccagtatctcattaaacaagaatcttcatctgaccagtgtgtcttttatttacaacacacaaaaaagcgaaacgtggtaagtgaaagaagcttcacaaagctgggtatgatcatttttgccccttcttgatatgattttcttttcttcttaattcttcagagaaggaagtattaacatcgtatattaaatgcagcatctagctttgtgttcacgtttttctaatttaacacattgcaattttagtccttcaaaactataaaaaaaatcttggattaacctcaaaggaaaaatgtatgtaggcaaatgaagtccatctaaagagagtatttctccaatatggtatcacttcagtgtcaaataatttcaccactcacaacactagtccagtgctaagaaatgagacccagaactagtgtccagatacatttgcacatacagatatacaaacacatacacatgcttacatatgtacacatatacatgtgtgcatgcatgcaaatacatacatgcgcaaatacatatatacatacacacacatatatacagatacgcacatgcatatacacaaatacatatataagtgtatgcatatatgcaaatagatacctacagaaatacatgcagatatacaatacataatgtatatacaaaaatatcatacatatgtatacatattactaaatacatactaagataataaggagagatgaaaatctttatccttattatctttattaatagaacgctttagaggactttcagatattctttatctttaatcatatccactagggcaaatgttgcctaaaagatacagagaacctggcttcttcccatttcacctctgctccttcctctctcatcctagaaggtgcttttccctatgctcagcacatcccttcagaacagacttagctggggatccatcccctccatgtccttcagccaattttcccggctctggactcacagactttctcagggctctgagaaggcctggctggtgccagcaattctctttgcccacatacttctcccctggccttgcctttattcaaatataagcattttcagggctggctcctctgtatgtctgcctctagaaataagataatttcttaacctcaaatgcttgttggtgttcatattagccctaggactaagacatcaggtgatattacagccccatcataatgctataaatgggatccacaaacttctattacatccaaatgaagagacgtgtttttgtgagatgaatggattgtgtagccaacgcccaggagttccagggagtttggaaaataattgccattggcaatatgtctgcagtcatactaccaaagagcgtattattgcagagtttcaccttcaatccacataggcttaaatagggacttcctatagctaagcaacctatgaacaaaataagacttactggaaaatgaacgtttgcaaaagaaggagggagcattcaatctggaaagcagaaactctagaaatattgtgaaagattggagcatggtagaaaaatgttaaagaaagaatagttatgtccacataatgaaaattagatttaaatgagccttgggagatcaagaatgtcaaccaacatcattttaaaacaactctgttttctcagtgccatgcagaataaacctcgaatgcatttgaaaggacaatgaactgggactctttgccctggcaaatgccatttaactgtttaagaaacaacatgcctgtgatgtgaatagcttcttattttcttctttaaagaatcgcttttttggctgggtgcagtggctcactccagtaatcccagcattttggcaggccgaggcaggtggatcacctgaggtcaggagttggagagcaggctggccaacatgatgaaaccctgtctctactaaaaatacaaaaagttagctgggtgtggtggtgtgcacctgcaatctcagctactcaggaggctgagacaagagaatcgcttgaacccgggagggggaggctgcagtgagctgagatcgcgccacggcactctagcctgggcaacaagagaaaaactccatcaaaaaaaaaaaaaaaagaagaagaagaatcactttttcttcccagtaggcttctttccttctttggagatgagcaaaaagtataaaaacatctgtggaaacctcctgtttgtatgttttacattggaatgggtgcaaaaaatacactcactattcctttacatccttctaagagggctgtttctactcttgacactcaatacttgtttttgtttctctaatcactgttatacgttactcacgaatattcatcaaaacccttttccttattttttatctagttttaaataattcatttgagataaaaagaagtttttctttgctttttttaatcactcagtggaggatgaacatgaagctgtaccaatggataggagaccgtctggtagagcacgggagccagggatagggatctgaagatggaagatgtgagtttcaagctgggctctgcccttgctctgggaatcacctgggtaaatcctttaaccctttcctgccccaagtgtgagctgagagcttgccagaaatgcagattccgagtctccagccctgctgagtcagaatctgctttgtaacaacttccccaggtgagctgggtgcctgctcacttcaacaagtgctgcattatccttttttgactctcaatttcttcaactataaaggtggtactgatggcaaccagctgccgagcagctctctcccaggacagttaaatgggccaaataatctagtgtgtgtaacaggtttcataaatcttaatattgtatttaaattatcatatgatagaagggtgatgtgactgactccaaacctctgcatgtgaaccatcagaattatccattctagtcatattattctaacaagccagatgcaaggaaaatcacagtctcttgtgtgcaaattatcacttattttttgtaagtactggattttcaaaccaagtatctacctaacagaggggaagggagatctagcatcttttacttcaagagcacgtctgtcactttgatttatagcctttttggtccctggtccagttcttttgtgggttttccattcaaattctacattagtttgtttaatgtcaattaaatcaaagctttgtgcaggaaggaatgaatcctggtacactccccagcgtgctgttggtattctctacataacaagataataaattaatagatataccatggtcttataacataatgttctttttctttctttctttctttctttctttttttttttttttacctagaatagcacaaggcacaaagttgatagccctcaaacttctgaagaaaagtcttttcttccaggatgtggaatccataatgctttctatgttaactttccctaaaaattgttgaatttttcataaacttctatgaggaagtgtttccatggcagtctggctaagaggttcacaccatcattctgtcctggtgatttttgaaacttacaagcccaggttgaaactcaggtgattcaaggcttgagaaacacaaaggccaagctcaaggagtagcaaagttgcttgcactttttttctattggcatggtccttctctgaacaccagggaaggggtggtgcaccacctctctcctcttcagaaggagctccgtgaaaaatcggcagttttatgcttggccctttcaaaacacacaaaggctaaaaatacagtgtgctacgcatctggaatgtgtctcatctgtgaatctctgacacatggattcattgttttcgataaaattccaggaattttattcatgagaaaattctggcacaatggaaaaccctggcaagcaaaagataggggcagcagatgtcctggcctccacccacaactctgtctctgcttttagctaattttcatcaggtgtcactctcatgccttcaaacactcaattcaaaatttcccataagacgggggtgagggggtgggggtgtcaaaacagccttaattttttaaataattggtacggtcccccccctccccacagacaggtgtgtcacaccaggttcaacatgcacgtgccaggatgcaggatgggcactttaagaagaagccgcaagaccacagggccactggccatggggctccaccactccgtgcccctcatgtaccaagtcttcaagctcctcgtctaaaatgagggtctggtctactgatgttttctaagactccattttgcaccaaaatgagatcgatttgtttaactagtaacatcctctttcagccatagccaggctgcagtctctacctcctccatctctgagcagacatgcagataaggtagaaatctaccatgtatggagttgctaaaaagttcctatgcatccaggttagatgctaactgcagggtctttccctgctgcccccagactttaattttcctcaatcttgtaggtatctccttctgtgctaatggtaagaagctagtcagcaccctgagagctagtgttatgtttttaagtgtggaaaggatctactctcttgcatgggaatatggcatctgttctacacataaagcacttcaataataataataaataaaaaaatttaaaaaataaaaaacacatggcaacatggtaataccaacagaaagtcttgtagaaactggggttctggcagacagaggagcacatgaataagtctccactattcacatgatggtccaggggtctccttcttttgctttctatccccatccccatcattgttggcatgggccacacactgtataacgcagacatgaacacagacgttttctttttcttagacgctgacttacgtagaaagagttagtcttcacccactgtgagggtccaatccctgccaaggtctttcttcagcttggtaagtgatgatgtctgactccctggggctgggatgctaagcctgtgcttttcagaagatttttccagcacataaatatatcctggttgctgcatggaaaggggactaagtagccaggtcatcagagccctttgctaatgttatacgctgagctcatgcttttcctatgacatagatgagcactgggtagaccccgtcctggtaacacttttcatgcactaacaagttggttgccagtgagacttgatttttatgactctgggagtgctgacctcaaaacctaatacatttgaactaggagagcaatccctccaacaatttcaaactacacatacttacatcacatccaatagggctcttttgccatctggcttgagcccctctataaatatgtctactttgaaagtcacaagcctgggcggggtggctcacacctgtaatcccagcactttgggaggtggaggcaggcagaccacgaggtcaggagatggaaaacatcctggctaacatggtgaaaccccatctctactaaaaatacaaaaaattagctgggcgtggtggcacatgcctgtagtcccagctactcaggaggctgaggcaggagaatcgcttgaacctgggggacagaggttgcagtgagccgagatcatgccactgcactctggcctgggcgaaagagcaagactctgtctcaaaaaaaaaaaaaaaagtcacaaatactctttgaaagtgtgcagagtcattcatatccaaaccatcaaggcctgcccaacagcctggtgacttgaaatcttgacgtgtacacagagtctaaacctcggtctttagattgcctccttactggacctctttacttattaagattcatccttgtggaggaagtgaggtcatggatgttcacatctatctttcccaggaagaaaaggaagcttcaagagctgggaaatgctatgcaccactgtgcaggttctgagcagcacagagccacctgtggggtgggcgggtaggtgagtagtggacatctgaccaccaggcgctgtgcaggactacctccttgcagagcaggtggggccttccaagttgcctactcatccaacctgcacagtaagccttatgggagcgtcatggggctacgcctacttcaaagagcaacttagctaaagggaaagagaatttgcacttgctctcttccactctagcagacttgcacttgtcgctatttatttgtgaacacagactcattttagattgacttaaaaataaaaaaaagtgcaaagaacagggcagctggaagttgggaaaccacttctgccactgctgaatctgaagccttaagctcctgaactggaaaaccagccgactggagcactgagctccctgggccctgtaaaagagcacactggccaggcatggtggctcgtgcctgtaatcccagcacttttggaggccaagacgggcagatcacgaggtcaggagttcgagaccagcctggccaacatggtgaaactctgtctctactaaaaatacaaatattagccaggtgtggtggcgtgtgcctgtaatcccagctactcggtaggccgaggctggagaatagcttgaacctgggaggtggaggttgcagtgagctgaggttgcgccactgcactccagcctgggtgacagagtgagactctggctcaaaaaaaaaaaaaaaaaaaagaatgcaccaagtagtggccagtcaggctcccatgggccttgacacgtgagatgtcaggcagaatttttattaatgaatctgatgccaattcagtatttctgcaatcacaatgcactttcgcaatatttatccaagcaatatttatccaacaaaaatatccaatatttatttatccaggatctcgcaaacgttcagtctagtttcactcacgtcagtgtctctaaccttcatactttgctttcaagcaagagtcgtgtgttggtctgggtgtccgaaggtgggggtggtagctggtgatgcaaggaaccaaaaattggccatacttacttacttaaatatttcacagctctttaacagattctcatctcctgctctcttctcttctccaaccttgccgtctggttctgacactgtcctgccacgattaggagtgagctttttggggttccctcaaacattcactcccagctggtctctttgttacctactcaagagcagttcatactgttggccactctccccttttttaaccctcttttctttggcttccatattcctgctattcctcctatttggttgacaattccatcccccatctctttatgccctcctttttctctcctcattctctaaatgtcagctttcctctgtgcactctcctgggccacttctctactaggctatcatttcttccaagccatcactcaggagccactccaatggcctcagcgctgccaggaagcgcagcgcatttaatttgaagggtgaaactgccttggagggatggcaggtgcatgcttaataacttgtttcccaaggccacataagtgtcattactggatgataattatcagctcaagagggaaagttctaagacagagaatgcaagatttctaaacaggtctaagacagttttccaatgtaagatttattatgtaacagttttgaaagtagtgtctgattccctgtctatatcctccagaacaatctgagggcatggttgccattacaatttactttgggggacgattttatagcacgtcttcacagacaacacgacaaacatctttgcttctgctacactgacaacctgaagttaacatttctgtacctatgtagccattttaatcaccccctaaactggttattccacagcccaggggtgtgggactgagtcagatgggctagagatacctttattcagaggatttagaagtttgcctcagagaaaggccatttctagtctccactagaaatcacacatatcttccaggaataagaatattctcttagtcataagttcaacaaatatgtactgaacaccttttctacttagaaacttgtctagctgcttctagattacatccatgacccaaaaccacaaagacacctatctgcataaggcttgtattctagcactacaagccacagataatttttgaaaatcaattaatcaaccaataattgatagggtaaatttataaccttgtttttcaagcctgatctcagggttagaaggtggtaagtgataagtatgaagaaacagaaggcagaactagagactcaggaaaagagaggtaaactgctgcttttcatttagagtggccagggtggtcctgagaaaacgcgaaggaggggagggtgtgagcccccatgcattcatgaagaataggccttccagccttggcaacagctagaacaaggccagagtggactgcgggggctgcacgaggaacaatgggaccaagaacagccagggaggaggggttactggaaaggagcgaaagaaagaaccaggaggtgaaccaggaaaggctgggggtggtagagccttgcaggccatggcaggaacctgggtgttgactcagagagaagtggagtctctctagccgtcttggctaaaagcccgggaattgtcttcttctgtgttgcactaatattttccatctcataagggttctgcaaagaaaattctttctatctttaaagttttattattttcaaaactaaatgtgatgagaatgcatatattgcatatgccatgtgtacaccaaaagccacacctaataaaatgttacagccatcctttgtcccacatgcaacgggaacttccattcatcatcacatgcagaaactctgggaactgagaatctgtacttttcattcagagtctgcaaggggtcacggccattttgaaaggctttgactcacacaggaaatacctcactgaggctcccacccacccatccactaatagggcagcctttagggaaactgacttgtggcaactgaaaggaataacggcaccaaagtattcccctgccctgaaatctctgtttacctgtggaccggtgatgggtgtgaggctgtaggttttaacgagctctgaatggcaaatggcagacaatggtgtcacttcctttctgcttaggaaggagacgtttggaaaaactgttcactgctgtgcttgcctatggagaacctggattcccagagctctatctggtagaacgtgtctccatattaataagcagtgaatcctcttttgcggctgaattttcctcaaggaagcagcatgggccttattactgccttaaaacccaatttcaatattcgatacatagtctgtgtattcatttgctagggttgccaagacaatgtaccacggactgaggggcttaagcaacagacatttattctctcatggctctggaagctggaagtcagagagcaaagtagcagcggggttgattcctcctgaggactccctccttagcttgtggatggtcatcttctccctgtctcttcatatcatcctccctctatgcatgcctgtttctgagtccaaattacctctttttataaggacatcagtcccactgaattaaggaccaccctaagggcctcattttaattggattacctctgtaaaggccctacctccaaataaggtcccactctgaggtcctgggggttaggacttcaacataactcagggaacactattcaacccataccatcctccaggaaggcagagaatgtgtccctcttcttcactgctgtatctccctgcctagcacagtgccaggtaccacactatgctctgtaggtcagtgattctccggagctctgtaggtcagtcattctcaaagtgttgtccaggaaccccctggggtccccagacccctctaagggcaggcataagcagatctgagaatccagctgcctccaattagcccagacattaaagagattgcaaaaaatgcaaaacaatgccacttctcattaacattttcttggaaaatagagttacttttcataaaaatatctcatttgtgttaacatgcaatgagtttatttatttatttttattttttgagatgaagtttcactcttgtcacccaggctggaatgcaatggtgtgatctcggctcactgcaacctccgcctcctgggttcaagtgattctcctgcctcagcctcctgaatagctgggattacaggcgtgtcccaccatgcctggctaatttttttttctttttctttttcttttttgagacggagtctcgccctgttgcccaggctggaatgcagtggcgcgatcttggctcactgcaaactctgcctcctgggttcatgccttctcctgcctcagcctcctgagtagctgggactacaggtacccgccaccacgcctggctaatttttttgtatttttagtagaaacagggtttcatgatattggctaggctggtcttgaactcctgacctcaggtgatctgcctgctttggcctcccaaagtgctgggattacagtcatgagccactgcacctggccttgttattgttatttttaaatgaatttataagtaaatgtttcaaaatttctgtttttgtttctaccaatagatataatgcatatacacaatttttttttaagaatcctcaaccaatcttaagaacgtaaaggggtcctgagaccaaaagattaagaatcactgccgtcgaggttttaagcttggctaggacacagtctgtacttactgaagtaacccacagtatgacagtaataagacactttatgaagaacatattttcagtagctaagtgtcatagaaaaggaagcttgttagccatttcctcaagttgacaacagagagtccttaggaaaataattttttaaagccaatattgagccttccaagactgcacatggtgatatgttaaatttggaatttatgcaacttaaaaaactgagagtcgggggttggcatttttgtgcatcctaactgacgagtgctgccccagggctctctaacactgcacacagtctactaaagaagcaggctgcccatcatgacccccacccatcagctacacagcacacatctgcttctagatgaaccttcttgcaagtggcctgtcttatggcaaaatcaaggggcaggcctgtaaagcggaccaggaaatgagcagcaactgcataccaccaacctgttgccaagctaactgtgcttttctggatcagaggcagcttgagacactggtccctggggctgagggactgcagagcccgggcacagactccctgcctatctcccagtgtgtccatcttggtacacctggtgcatctctggattggcaagtggcactccccaattaatgttaagggccacttgttttaaatataaccagattattttaatttttaaatgtgtatcccatacttggacactgaaaggtcctccctgtttacctgcttgctggggtctgtgcttgggtgtctcattttattataaaacagagtctcaaaggcatttaatactaagatcaagtggctgggcatccatcatgtgcagagcaggagcctgatggtggtgaaggctcattctgcatgtggttgactctaggaactactttaacagaggggaagaaatacactgggagaaaggagcaggagattcgtcagggctgggggaatactggctccatgagggcagagacttttttctattttttctctttttcagagcctgtaagtgtccacatatcatgcacatgcagtgcgtatttgttgcatgagctcctggtatgcaggtgccaaatgtcatgctaagtgtgtcgactggatgacagaagaaggaaggagggattaaaggaactggtgtgcactggcctgagccttgaagaatggggtgtactgggtaaatcaaaatggtggggagcatttccagatggagaaactgcaaggaaaagcatagaagtggggccacccctcgtgagctggggagggcccagggtatgtgtgctggttggggggaagctgaaactgaggaaattcccattggatccatagcctggttctggtttccacaggcctgggatgccccgtccagagtttgactttcagtctgcacgtaatccaggctttgtattcccacttcccgtatcccctcactcctttttcacacaccctttttatctatgatgctactggggtcatgggttaagaagtcctgtcgtctaagcagcaagggtgcatcaaagcaggattttctccattgattccaaggtgtgattcagaaatggtaaaaactccgaacactaggatgagcactggggatgggttcatgttttttttttatgaaataattcagaacttattaagaattcccttggcaaaccaaattaaatattaaacaactatttgttaatatgttactattggattctatcttagaaaagtgtaattatgtgtaactgaactttttgttttcttgtggttgaaccctgaattaccatgccttctggtttccgtgtttttcctggggaataggtcatatttcttacttccaaagcccagaaataaaagcctcacacatccatccgtagtcccaaaggcttttctgcctagtacccagagagtaacagcagtgcttcaaactatttgtggacaagaagtcctaaaacatcagacacactgtggaaagcaatttcatttcattaatacaattcataattaactgcatttattttattgtctaaattccaactgctaacctatcatatcgacgaattctttgaagttgcctttattctacaggatatgttcatttttagataatgctatttttcatatactttaagttctggggtacatgtgcagaacatgcaggtttgttacatagttatatacgtgccatggtagtttgctgcacccatcaacccatcatctacattaggtatttctcctaatgctatccctcacctaccctcctaccccccgagaggccctggtgtgtgatgttcccctccttgtgtccatgtattctcttgatcatctcccacttattagtgagaacatgtggtgtttggttttctgttcctgtgttagtttgctgagaatgatggtttccagcatcatccatgtccctgcaaaggacatgaactcatccttttttatggctgcatggtattccatggtgtatatgtgccacattttctttatccagtctattgttgatgagcatttgagttggttctgggttcatgttttaaaatctcaatttgctccctagtcctaggaatgatcttctccacctccaaggaatgcaagccccagtgcaacatggattcttcctctgtaagaggctagactccaaataatttgtcctgtttttgcctgtgggatgttacaagtgtaccctgctgtctgtaattgtgtttctgaagtgttctatgtaagtaggtttttgttagttgaattgtactttaaatgtgccaatcaagttccccatgaaaagagatgggcacagagactttttgaaaaattaagcatcccaagagaaaagccgatctgaaaagactacatattatatgattccaattatatgacattctggaaaaggcaagactacagagatactgaaagatcagtgtttgccaaagattagagggagggaggggtgaacaggtggagcactgagggtttttagggcagtgaaactattccgtataatcctataatgttggatacatgtaaatatacatttgtccaaacccacagaatgtccagcaccacaaatgaacgctaatgtaaactacaggcactgggtgataatgacctgtcaatataggttcatcaactgtagcaaatgcactccgatggggaatgttgataatgtgggcaaggctacgcaagtgtaggggcagcaggtgtatggaaatcactctatcttcctctcgggtttgctgcgtactaaaattgctctgagaaataaagtctattttttaaaaaatgaagtattccaattaatttataagttttgccacacgtgcaatgacggccctaaccactttactttggttctccgatactgaatatgtcactgtgaatatctcatcctccttgatcccatccccatcaaaactagagattgaaataaggagatgagatggccctccctgaccgccttgtgcctttcagaggaggtgcctgggctggaatggggaggagctaaggactcctgtgggattctgatgctgggtgtgaaactgtctgcagttagcacggtgttggagagatgagtgctagactttgtatttctggggactagtgataaatgctcattattatttatataattttaaagctacgtttaaatttgtccccagtactagagactttaatgttatattgaaataatacataataggctgcaaatagttatattcttgtcttgttgttgtccatgtatcagcattcttgtatgaatgaaactagaaccaagaagaaaatccatcactacaataatggtccatacattaaaacagtttaggctgtctgatggtctggggtgtgtgtgtgtgtgtgtgtgtgtgtgtgtgtgatatagatatgtatgatatatatgatgtatatatgatttatatatatataaatcatctcatcttgctcaaaacaatatcactcttatttaggtaggcacactggaatatgattttaattaattgaaaagtacagtttgtttcacatttgcaggagtggtttaattcctacacagtgtactaagatggcctctcgtgggctcatgatcctggaagatatactcccaaagtgagggggggtctatgttggaagcaaaaataaaaggaatttaaagaatgacaggtctgggaaattattcttatggatggtcagttcttcatatgataaaatagttatgacaaaccaaacaggcacagtctcatgtatgcactgatttgcatgaaccaactttacagataattgattcagttggttggaactacagtttcttccaaatgtggacaacttacaacagggtgggagccccaaactgtgaagtcatgtgaggtcatatacaaactgaaaaacagggtttctctactggaatgataatcctaccatgttacacttttccccaaaatgaaatccaacatctttcacctggcgtaagaagcccaacatgttctggcccctagaaacccttacatcctgcaaagagggactagagcttgttactcttattagctactcttaaagtcacagaggtagttaatttggcaaggagtggctacaaattcaagacatgtttggatgtgctgagaatcagaatccaatctcggccctcaagtcatgggttaaagacttggttttttatctatatgaggtcctaccttgtagttcaagcagaaacatccaacaaatgaaagcagaaacaacatttgacagctcaaattcaaaagcaagaggcttgtcaatgcaaaagtcttgtgctgcaaatgtttcaagggaagtatccatactctgaagtgtgcaattgaaagaatgacctgatattcttgcactgttgcctcaaacaaacctccctcctcctagctagctccggatcttttatgcatcatatagtacatcttcccaaaaaagcaggtggaaaccaaagtgtgcaaaaacacacattttccaagaacaaatgcattatactagcaagttatgtgtggtggggctaggtgcttctgcgggtgtggaggaggaggagagaaagaagggtcaggaggaagtgtgttgggtacagagacatggaaataagaaacaggaaccctgaaagacacacccgcggaggttctgtaactgtacatgtgctcttgttaaatcgccagtttcagaggactcagatctgaggccatatagaaatctattaatttgcatcttgactttggggcttccagtaacagtaagtatttgtatttcaggatccactcagcagaaaggccatacatattcaagtcacataataaattggtgaattccaagtgaattgtgaataccaaaaaagaaaactgattatgtgactttctggaatatgatgtagaaattgacctaacaaaatgtatatgcacacttacggcatgtgtgcatgagggtgtcatttatgtacacaggtcatgtgcacatccaactcatggccatgcatgctgtagcctgttacccattctgggagatatgtaagcctttgtctttctccctccagcttcctgccttcttaaaacatttcactggtcatcaaccaatgattgaagctgggtgcagaaaaggagaaaaggtgaaaactcctcttagtccacaaggtgacgtgttagtgcttcaagtgaaagggctgtggtggagagccagagaaagcccttaggtggaatgagactgtggttcctataggtcggcaccttcctccccacccggcaggtcagctcatcaattgcacttatctcccagctgccacagcctgtctcactcctttctctctcctgttgggctgctaccaggcctggtaaactattccgtagctctgtgcaatagaaaatagatatgtatttctctgaatatagagagggaaattggagttcacatggaatgcatactgtaaacttatttgttttctgaaagcaaaaattaaacttgaaaggagcaaagcttttcaaatttcccatagtgctggcctcaaatcctaaagatttttttccttgacaagaatcatgggatgaattggaagatctggatgctccattcaccacagttgatgatgctaaaacccatgtgacagcagaggaaagaattgaacattctaaagtcccctctggcaactggaatgccaggggagccttcaccatatacctcatcaagccaccccaacaaacctgccatgtcggtgaaaagaccatgctcactatgaaaatgtggcttctgccgggtgcggtggctcacgcctgtaatcccagcactttgggaggccgaggcaggcggatcacgaggtcaggagatcgagactatcttggctaacacggtgaaaccctgtctccactaaaaatacaaaaaattagccgggcgtggtggtgggcgcctgtagtcccagctactagggaggctgaggtaggagaatagcgtgaacccgggaggcggagcttgcagtgaaccaagatcgcgccactgcactccagcctgggagacagccagactctgtctcaaaaaaaaaaaaaaaaaaagaaaaaaaaaaaagaaaatgtggcttcaagaccagaactctagccctttgtccaaaaaaaaaccatagcccccgagacccctgatggccttgacatgccactgggggtccccttatctatttacattatagaagggcttctaagaagaatggtttcagtcagagaatccaagcaacttatgctaaagtccagcctcatcctcagaactctgggcatgcttgtttttaatgccatgtctatccatctgtgactcattaacgcacttagcaaacactgagtgactgactagtctatctctccccgtgataaaatttaaacgcctcttacaagacatgagtagtctacctacctgttacttgtatgccattacctgaaaaattcccatctgtttggatgcaaacttcacagaaactctgccacaaatgctcacgaacaccatcacatgggctgggctctagtgctttggaatatcctactttcttagaaaaatcgatgagtacatataaatataattagctgcaccttgattcctgcggaatcattgtattaactgctttgggctattctccttctttcctttcaggcaatattaatttgtaacaaacacattttatgatataataaattatctttcattttttactatcaaatacatggagaagtaaaaaaacaaaaaacccagaacttctaggcagctcttaaacaagtcttgctgttacttggaaaagtaacaaattcacaggtttattgtctatgttaataaagctgtgttggagtagtcattataaccttttacattccctcctgtttacagctcacagaatatgtttacacatgtgatctcattcagttgtaacatgatctgcataaattatgggtattaacacttgccatatttattacaacgatttccccagcaatttgtcttcttaattgtataatctatattgcaaacagatgtctgcagtttgtatatgcagctatgtactcctatggtttatgcatctacctcaggccattaaactgtaagctcctggagggcagggatgtatctgattcatttctgtatctccggaacccactgcacagctgctgaatggatacacatctagttacttaacctctgtgtccttcagtttcctcatctgtgaaatggctataatgattgcaggaacctgtcttctctgtcccaattgtattaagcaaaacacttaatacaatgtctagcatataataagcactctatgagtgttttctattattattattattattattattgttataattatctggagttaattgaattaaagttcaaaaagatgacctaactcatttgggggaaggtgatgaataaacggcagaaagaaaggaatatcagggatcttatatgctgatcctagctttgtctaatctgccaagctaagtcgtaagatttttctcttttcaaaatacttctgttaagctagtaaaaattatttacttgtaaagattccatgtgctgctttttctgtcataattgcatttaccttaccaaatacatattgaccatctacacagtggatagcagaggggccacagaaatgagtaaagtctagttcactctgcactggtatctcttttcttccatatttacattttataattacatttgtcaaactgcttcacaggcgaagtcctggaccaggaaccaaataaaattgacccagctttccgaccatggaaaactaaaagtataatcaactttggcaccattaaattctgtttcatttattttttccaagagtctattaacattgtcatacagaagtagaagatttaattgagtgtgtgcattttgagttgaaagcagatactaacaagaaaagctaacctggaagacatcttgtaaactgtttcatcagactggaccaggagccaggggagggtcgaggtgactcagggctgttggcaaagctgcagaaattgccactgggtttctctgtcctctaggcaacctaggctgcattggctctctggcctattattcattacggtttagttcaccacagaggttgccagtgagcagtgcataagattagagattttgtaaaaacatgttaatttgtatgaagacgaaaattggactatggagtttagtgataaaaatagataaacagttctgtcatttgatttaaatattaaaataagacaagacaaagcttttaaggaaatgaccacttcttggttctcaactagaggcaatgcctcttctgtcctgagcagatgggtgtttgggaatacgtggggtgacttgggttgctgtgataatgcaggggttctctggcaatcagagggagagggaggggcaccttcaaactgtggtccagatctacacaatcaggaaaggctgttcacctaaaattcaaccttctgttgagaagagcaacacttacggagctcatcaaagaacgacaaaccactggaacagttcttgagaccaaagtctcattcactctgggacatatccagttacataaatcatttatgttttatcccgtctctactttcccaagaaaccctgccacacattcatagtgaatatcaaacctaattaaagatcctaagcagctgagaaaattactcaatgaccaaactataattagtcttctacaagggagaaaatgtattcaaatcattgcttaattttgtttcatttcctcttacctgcacttgaccattaagatcaaaagtctgagaatttgtggccaaaaaaaatgaacatgagtcaaagtcacatctatttgttaataatggaaagtaattccttttctaattacacgtgaaaatactagtatccaacaaacctatttgtggaaaatacggtttagattgggaaggttaattactttcaggtttttcaatgtccaaaacacacctcagaactaacaggctcagacaagatctttatgagatcactggatcctccctccaaaagcttccccctcccctgttgatctctattccatatgctgcttcatttgatcgtatagcgtgtatgatgagcctgaatgcgggcatttgttgatttgagtattacctgaaacaaaagatacaccagaatgtaaaacccaggagggcagagactgttttcccagaacctagaacaactcctggcacataccagatgtaaaatcattgtagaaagaaagaaagaaagaatgaaagaaaggaaggaaggaaggaaggcatgaaacggtgcactattattgtatgccaccttaagtcactcatagaaaatactgcatgccagcactctatgcaatgggtgttacactagccattatgtaaagtcaatgacgggattatacgctgggcactttataatttaataaacacccttcaattaccgtctcatttgctcctccatgccactccacatagtatacgggacatattttaggatcaccagtttagagataaagacagaggttgtgtccccaaagtttgcttgcgagtgtggtatttgtaacttctaaaactctaactctcccctgaaaacacgtcctaagagtggtgaggctcccacgtgaggtggcaatattggttacccccgctgagctcatcacattgcgcaggcctccacagggcagctacactctacgataaggaacatgaagccctgagagtcaggagggagaaaaaagaaaatgaacgtttggaaaagggcattcccaaatcacaggagaaggggaagaaacgtgtctcagctactaagtttctcttttccatgacgctcaaagcagaaaatggctgcacgtgggcaattcgtgcgcttggagctcagacctgcagtcttgtcgtttgtctgccctgtcttggtgcatgctgggcctgacttttttatttttccatttcaaggagccccagcagggcctggaggaaatgagttttgcagcccatctcggcccttgagcttggctcctcggctgacctcggctccccgcctgcagacccggcatgaggcaggcagcaggcactgcggggcagaacttccgggacctgcaagaccagtccgctgccttctgagacgtagttctgaggtgtagcaagttttcattttcacagcataaaaccgtctacaaatacatacttcaaaatgaaatggaggatgcgctcaaaaaaaaaaaaaaaaaaaaggcttagagacacgtcaaaagggcacaggagctcagccaggtcaaataaattcccaaatttgactcacatcacttcagcctcatctggatattacccacactctgcctaggcaggcgaagcttccgtgggatcctctgtctttagtgaattctttcctttatcttgtccagcttttcattgctctttcagaaactgagcccatggttttaaatcttaatatgaccttgcattcaattatatatatacatatatatatatatacaaagctgttttttaaagacaattttaaataagaaaaaaataattattttagataccagagagtggtgaaataataatgattcaaacttaatcctcacttcacgtaggggaaattgactcaaatctgggagcatcaaaaattaagatgcatttacaaatcctaggagaagatatcctttgtaatctcagagaaaataattgagagagggaaaattttttttgaaagacgtggtttggacatattactattttgtgaaatgaagttaaatgtatggtacagatattaaagttcacttaagttttatctatataaagtgtgtgattttggatctaaacaggcataaatatatatatgtgtgtgtgtgtgtatgtgtacatgtttgcgtacgtatgcatgtgtatgtgtacatgtttgcgtatgtatgcatgtgtatgtgtgagcgtatgtgtgtgtaagtgttgtatatgtgtgtatgtgtgtgtatatgtatgtgtgtatataataggaagtaagttggaaaacatgagccaactgacttttttttccttagacagctaaagaagagtggttagaagtttactcacaagtaaatcttttaaggagcgtttacttcccagaaacagcaatgagatcttggaggggcaattcttgtcaactgtgcatcatcaatggagtttaactgtgagaggtaaaacccattgttggtcccgactccaccaacccaaatggtcatatctgaggacttcctgtggttctcccgcccccaccctctccacggcatttactgctcctgtataccctggacttctcgacaggaaatggcaaattcctcagtaggaaagccaagaagtgggaggtcacatggagactggaagttcattgcgtgcagcccctccaggtgacaggcgacaccgcctctgcatgttgagtgcctttgtgacacatgatctccttgtctcatgaccacaggcagcagggtcctgatgagtgccctggagagaactgtcctcccacccctgggtgacacagagtctcagaagccagcagaggtgctgcaccaaaggctcagactttcaccctgcctctcttctcctcaactctttgccctaaaaaacatgtgctttgagggtgtgttgaaaatctcactaagtcaaatgatgcctgtggggcagaaataacccttgctctgaaagggtcaccaaaaagtcatgagactcctacctgtatggaaggtggtgactatatagcccttgtataaacaaacaaatacggtgaaagacttggctccatttttttttttttgtctgttcgttattttttggagaaaacgttgtgataagaagcctttagcctacaaaaatgtctctagattaatgataatttatctcacttttctcagtgaaacagatgaatcaaagaaagtgaagcatcgtagacaatataggaccttcctgataacatctaacatttaataacgtgatcacagcgtggcggctctaaaagacatgcacatgtgaattaatgcatctaacctgcacactagctaccattatgcccattttaaagatgaggaaaactgagactccaaaaattaaataagttgcctagagcatcttgccagttaatgcaccagaattctaagccagctgcctggttccaaagcgcatgcccataaacgcggaacataatgcaccaaatggcctagaactgaaacgactgcaaaaataagtcaacatatgagaaactagagaatatataaagccagccccaccataatcagtggcaagggatgggagatgggaagaagggagaagggaagggaagctaaataatttcagtttttctctgtgcctttaattcctgtcccctgaagatgacacgctcattttagtagcaacccatgaccaagatgcattccccaagcttttcgcacctgacagaaagggactcggtgtccaggactgtgcccgattacaatcaaagcagatggacccttccttagggtagggctgttcttctgacagcctcctctgtgaaactagattataagaggatgtgctgctctcagacaccctctgcctgtccccgccttggggtccttgcctttgccattcccctggtccgcatcactcctccgaggcatttgcaaaccttgttctcaccttttctttgggtctctgtctgacaggccttgcctgatcatgttctctaaactagaggtcccgccccccggccacctggctctatcatgttccctaccttccctcctaaggctcctgacttcctgccacactctgtcttcgttgagctgtgatctatttgtcagtctcccccatctgcatccccctgattgacagcactgagtgagcccagctgtcctgctgctcatgcccctcagcacccatgagcctagtgggtgcccagtaaatccttagtgagtaaatgaatgagtcaatttccacacaccaaatcccaaagggataaaaagacattgcctttctgccatttcttggaagaattttttgagacaaactaaagaaaggaagctacttgttattaaatttttaaaaatctgcctactattttcaggcaaatatgtcatgatgacatctatgaaatctctgaaattaaagagaagcctgacgtttcacaggaattaaatgaagttgctgcatcacaggtgctccctgccacagggctccgtgtggcagcagcaaacagaactcctcgctgcttaggtgtagtccttaggaatgaaaatctgaacgtagtacgttaaaaaaaaaaatcttcaaaagcaaacaaagccctaagtgtcgctgtgtattatcagggcagggtcctcctcagagagaggcgggctgcaatcgcccctacacctttcaccaagtgcctcgcttcaggggtcccattgtctccacgtttaggtttaggagcctggctcttcgtaacaccagcgaaacatgttctcctaaagatgttccctgagatacaacaccactccgcattgtttcaccacataccagcattaatatcccagagtaatccaccctcctcttaacggctgatgacggctccaatggccatgcaaaaatcagttgaaggaaagggaagtcttgtcggaaatgagattagtcttgtaacgagtgttcagccctgataacccatctgggcacagaactgcttaaactggagagcaattaaccttcacccgacaagctctgtccaaccgttataaacattaaagagacagaatccttcccccctccttgtagactaaacaaccagatttgaaattccacgtaaacggcctctttctgcagatgtgcaccaacaacaacgtttagggggaaaaggtgggcaatggctctgttcataactctggtaacttttggccttggtgtgagtgggctgaggttattagcgtaaaaattaactggaggtatttccaataaaatcaccaggtttaggggactggacatagttgctttcatgcagaaacccatgtgtcctataggaacacaacttgatgcttgagagattcttttttcttttctttctttcctttttttttttttttttttttttgagacagagtctcactctgtcgcccaggctggattgcactggtgcgctcatggctcactgcaaccttgacctccccaggctcaggtaatcctcctacctccacctcccaagtagctgggaccgcaggcgaaggccaccatgccccactaatttttctgttttttgtagagacaaggtttcaccatgttggctaggttggtctcgctcaagcgatccacccaccttggcctcccaaaatgttgggatgacaggcgtgagtcactgcgcctggacttcttttttcaacagtagaaatatttgcactgggctagactctcactcactcccaattcctctcttccgacatttgcatgagtgatgctgcttgtggtcacagaagggagattttttttttaatctccgagaagttattggttttcatggggagcaaacctgtgatcttgcctttatcagcatttgccgtaaccagtcgagttaaccaagttgggccatgtgaaataccgagtggttagagaatctaccaggaaacctactgttaaaaataactttcacaacactgaagagaaatagctgaggtcacttaatttatcactcaggcatgagctttctttagcatcagttcatgctgagccattggcttgtttatggacatgatactaacaataaataggtaaagggtaagggccctatgacatagagctggctacaaaccaatgtggggtacacaatatgcctagcatttaaacaagaaaaaaatgtaaagtacatgcagaaagtcatatgagggaaccaaacctctatgttactgacctgttaatgtgactgcaactcagatttttttaaatagaaagaaaaaaggaaaacatatatttagcatgtcctaaacaaatttatctccccaaggttttagtgcaatcttcatgatgacctgagatagctatcaaaatagtccatcctaacattcgatcttatctctcccttgaacccagtttctctttttccagtaggtaagtcataatactccaggcctcagagacgtgtttgcacacaacgaggctgagcctatctcacttataaggatgacatatctcactcatgctggactccagaccggccccaataacagttttggagagtggcatggtagaggatgtgtgttacatgggaagtactactgtaccctgggacaagatatcctggcaacaggtcttgttttcatggtttgcatttacatgcttaactgttccttttcctgcctttgtaagactaagaaaatccttactgtacagagaaggaactgtgaaaatagagcaagtgggactgactctcacattgcagggatatgcaccatctccatttttgcagccaaattagatgcaagcccaggattccactggcctggttctcccaggaacactgggagtttcttggtgtcttagcttgaggtgaggtgaagatgggctatgggcacgtgagctgaccagtttttcatcctgtgtgcattggacgtagacaagggcacacacagacatgacaagaatccatgacctagctcctaatgtaaatcttctttcccaagacaatcttgcagagccctcatggtcagtgataagaggaacttcaatttttatttggaatctgacccatttcataagaatgagtaacacctgaatatttaggtgcagatatcaaagacagaagacaaaaagaaatcatagtgtttgacaataatattagtataggatgccgttttatgagttcagtcttaggactgtgtaggtgcaacgtgaagactttcctgaagacagccacatgaatcatttttcataggatgtaatcaccactgtcatccattagtccaggcttgacacatagaatgggggtgactggctgcctaagtaacaaactccccacgtgtgcttctgacgaactgtgtgggctgccctaagcttttgcatgtctcgacacttaccaagtaaaatgatgagataaggaaaaccacaacatcatactcagtatcttgtgaaactgaaatggttgcagagtaaacactttgccttacagtgattttattttgactattatgctggatttaacaatataatggttaatatccatgctataaagttttattttttcatcaacaaaactaattgcattggcactttcaaaatgttgtttgcacataaatgatttatacttaagtatgagtgtaacaatcttgccatcaggacctggtctgttgggagatatcagtgaatggagcctggctcttccaatgggcaaccgttgtttgttggtgaagctgccacccttgagacctgcctggtctccttcccacctgtagctggctaagtagtgtctccccacaattcacgtccacctggaacctcagaatatgaccttatttagaagtaggatctttgcagatgtaattaatgattaaaatgagatcatagattagggtaggttctaaatccagtgagagcatcctcataagaggctgagcaggacacacagaaacataaagaagaaggtcgtgggatgacaaaagcagagacggaagggatgcatctacagcagtctccccttatccacgggggacacactacaagacccccaggggatgtctgaaacctcagacaggactgaacccaactgccattaactggaacactttctgttccatccacaaatgcaataccttttccatcttaactaagcacttactatccactgtggtcatcagttttgcagtttgaggtgcaacggcaaaacaagcacagatttctttttatttcttcaaacttcaaagacagaagattcattcttactgtacatcttagcaaccacagcatatgatctttttccttgtaagtacagaactttcaccttttcactgaaagaaagcactttacggcttctctttaacatacccggaattgccaggatcagtcctcttgtgccttggggctactactgaataaaagaagggctacctacacataagcactgtgataccgtgacagtcgatcccataaccaagagggctactcggtgactaacaggcaggtagcatctgtagcatggatacggtggacaaaaggggaattcatgtcctgggtggagcagggcaggatggtacaagacttcatcatgctacttagcatggtgaacaatttaagacgtatgattcatttatttctagaaatggccatctaatatcttcagacagcagatgaaactgccagaaaccatggaaagtggaatcgcggataagagaggactactgtccaagccaaggaacacagggcttgcaggcaacccccggagctggaggaggcaccagatgcatccttcctcacagcctccagaagggaccaacccagccaacacctcgattttggatttctggactcccaagctataacagaataaatttctcttgctttaagccactaggttgtaataatttgtcacagctatcctgagaaactggtaacagtacttgtggatgctgtttttaacaaaaattttgccactttagggcactatatggcctttttttttttttttttttttttgccttatagagttaggtcaatttccaaaagtgctggagtttatgccaagaattaagtgactccctggttgcagtggccaaatagcctgaaattttcaaagtaatactaattttgcaaaacttttcatgtaaactcctttgcctgaccatgccctaatttttgtgattaggaaaatctggctcttatcccactggaggaaaagtgtctagttcatattctaatggaaatcatcacttgggaggtgttttgacaaacatctctcagttttgtttaaaaattatgttagaaattaagaaaaataacgaatggaaaacaaaatctaatttttggtatattttcctgctaacatttgtgggcaaattagttaaattatgattgtttcatgcatacttactcctccaacagcatcctagctctcttaggagttccttttaattatcctaaaaacagttaagagtatactgagccaaaatataattaggttgagaaacaatgaactcctaaatgaccaatcaagttttttccaacattttaattctcaaataaaggtcatttccttttatttgactccttaaaaactagattatagttcttctaggagaggaaccaagtcagatttcttttaatcacatacattgccaaatgcatgctttactcagggaaagatttcaatatgcatcatttattcatgcattcattcattcaggaaacagagtagcactttacatgcggacgctgtggaaacaatggtgatatgaattcttaaatgattaaagaaacagtccactaaaaatcttatcaagataatagaatacttcagattttatgaaagattacattttcattggcctatatataatgttttaaccagtaaggctcactaagttaaataatatgctggataatcttaaatttacagaagggttttcagttttactatttggcttagataagctggtagttacttgctaaaattaatctttattataaagcagatcatcttgaaactgaatacaaaaacaaacgtagctattattgaaaatgttatgctatctcatatccattagagatgttatttatataataagtactgtgttgtaatttgcctgattccaatgaatacagaaaccctcagtgtgaatcaatatactagacaccagcagacatatttaaaagattgctacagtttcactgacatttcaaagaggtgactgtagtaacaaaagaagaaaaatgaatagtccctatcatagcacattaatacaacttgtcactagttcatgtccagaaagacttattatataatagattgtcaaagttgaatatttcaatgacccaatgcaaatcctggataaatgctggtaggtgttgctgctcaataaaaatgaaagtggtgtttggttttgctcatcaaggcaagtgtcatgtagcaaaatgcaggctatgggttgcctggaaactgtattcctgcttttaatttacaagtgaaacattcccatccatggcctggaagggaccatcatgtactcggcagcactcattagattctgggcagcccccggtcatctgaccttcccaaacatagggaaaggacgtggatagacattttcccaaaaagacataataatgaacaatgggtatacgacaaggtgcccaatatcactaatcatcaggaaaatgcaaatcaaagacacaatgaggtatcacctcacgcctgttcagatggctatggtcaaaaagacaagaaatagtaagtgttggcgagaatgtgagaaaagggaatccttgcagactgttggtgggaacatggaatgttgcagacactgtggaaaaaagtatggaggttcctaaagaaattaaaaatagacctaccatatgacccagcaatcccttttctgggtactttcccaaagaaatgtaatcactatctcgtaaagatacccgcagtgccatattcattgcagcattactcacaatagccaagatatgaaaggaaccaaagtgtccatcaatggatgaatacataaaataaattgtggtggatatatacaacggaatatcatttagccttttttttttttgagatggaatctcagtctgttgcccaggctggagtgcagtggcatgatctcgactgactgcaacctctgcctcccaggttcaagtgattctcctgtcttagcctcccacatagctaggattacaggcacccacgaccacaccccactaattattaaatttttagtagagacgggctttcaccatgttggccaggctggtctcgaactcctggcctcaagtgatccacctaccgtggcctcacaaagtgttgggattacaagcgtagccaccatgcccggcccatttagctttcaaaaagagattctgccaattgccacattatggatgaatctggaggacgttatgctaagtgaaataagccacacacagaaagacaaatactgcatgatctcacttatatgtaaaatctataacaaacaaacaaacaaagactcaatggggaaatggggagatgtaggtcaaagaatataaagtagcaaatatgcagggtgaacaagtctagagatctaacgtacaccataagggatatgcttaataataccgtgctgtgctgtacttgggatttttgctttaagagtagattttaggtgctcttgccccacaaaaaaagaatgtgtaaccatgtaagatgatggatatgttaatttgccttcactatcagaaccttatcaccatcttcatgtatatcaaaacatcatgttgtacaccttaaatatataaaataaaacttttaaaaaataaatcaaaaagtcatagttcaaaccactcttttggaaaagtatggatttgttaatataagtggtatataacaattgtatatgcatctggggaaaatggactccatctttcatgatataaaaagcaattctcggccaggcatggtggctcacgcctataatcccagcactttgggaggctgaggcaggtggatcacgaggtcaggagattgagaccatcctggctaacacggtgaaaccccgtctctactaaaaatacaaacaaacaaacaaacaaaaaatagccgggcatggtggcacacgtctgtagtcccagctactcgggaggctgaggcaggggaatctcttgaaccccgggagagggtggaggttgcagtgagccaagattgcaccacagcattccagcctgggcgacagagtgagactctgtctcaaaaaaataaaaaatttttaaaaaacagcaattctttgtgattttaatatagggtgccagccacatcactgattcatgcactcactcatgcatttgtcatgcaggaagttatttattcatttatgaaatggacatttactgatagcctgctttttaataggcaccatcagcatgactgaaaggttacatgacaacagccacagaacttaaggcatagaactttaacaacacacgttttgagttactggtcttgacgcctggctaattttttgtattttagtagagatggggtttcactgtgttgcccaggctggtcgtgaactcctgagctcagacaatccacccgcctcaacctcccaaagtgctgcaattacatgtgtgagccaccgcgcccggtcggggttctatagattcttaatcatgattaaccagcaatatgataattcaatagatccctgctcacctcccctaaagaatgtgccactctaagtagttggttcaaaatagcttgactttttaacctctagatccactccagagaacagtggtctctccccattgcacaaacacattcatttatttaacagcatcacccaaagcataagaatgggaggaaacaatgaacgtccttcatttctccaactttaaattatcaaaactactgattttctgggctcacaaaaatgcagttgagttcagctgttgaaagtttggttaacatgtcagttgagccaccaaatggaataacagttgtaactctcttatgttttctctactgtcctcaaaggaatagcatgagaacaaagcaattagcatacattcaggagttgcataatgatgttttggacaatgacagactgcagataggacgagggtaccataagattataatggagctgaaaaatctctatggcctagtgacatacagctgtagtaacactgtagcacaatgcatttctcacatgtttttggtggtgctggtgtacaaacctactgtgttgccagttgtataaagtatagcacatacaattctgtacagtacataatagttgataatgataatagttgactatgttattggtttacatatttactataccatacttttcatcattattttagagtgtactttttctatttccaaaaaaaaaaaaagttaattgtaaaacagcctcaggcaggtccttcaagaaggattccaaaataaggcactgttatcgtaggagatgacagctccacacagattattgtccctgcagaccttccagtggcacagggacaagatgtagagatgaaaaacagtgatattgatgatcctgaccctgtgtagacctacgctaatgtatgtgtttgtgtcttagtttttaataaaaagtttagaaagttaaaaaaaaaatagaacaaagcttattgagtaaggatataaagaatgaaaatatttctgtacaactgaaccacatatttgtgtttcaagctaagtgagtacaaaagagtcaaaaagtttaaaaaattaataagtaaaaaaagttatagtaatctaatatgaatttactattgaagaaatgttttaataaatttagtgtaaatatacagtctttttttttttttttttgagatggagtctcgctgtgtcaccagactagagtgctgtggcgcaatctcagctcactgcaacctccaactccctggttcaagggattctcctccctccgcctcccaagtagctgggattacaggcatgcgccaccatgcccggctaatttttgtatttttagtagagatggggtttcactatgttggccaggatggtctcgatctcctgacctcgtgatccgcccacctcggcctcccaaagtgctgggattacaggcatgagccaccgcgcctggccaatatacagtgtttataagtctacagtagtagatagtgatgtcctaggctttcacattcactaaccactcactgattcacccagatccacagccactttccatcctgcaagctccattcatggtaagtgccttatacaggtgtacaggtgtatcatttttttcccttcttaataataataattattattattttgagatggggtctcgctctgtagcccaggctggagtgcagaggcatgatctcagctcacagcaacctttgcctcccaggttcaagcaattctcctgcctcagcctcctgagtagctgggactacaggtgcgtgccaccatgcctggctaattttttatatttttagtagagacgggatttcactgtgttagccaggatggtctccatctcctgacctcgtgatctgcccgcctcagcctcccaaagtgctgggattacaggtgtgagccaccgcacctggcctctactgcattattactatacctttcccacattttgatacataaaaaccattgtgttaagtgtcacaattgcctacagtattcagcctggtcacatgctgcacaggtttgtagcctaggagcacaggctacacttatagcctgtagcctacgtgtgcagccggctatgccatgtacatttgtgtaagtgctctttgtgatgtttgcacgatgaaatcatctaacaactcatttctcagaactgaccgggcatggtgatgcatgactgtgtagggaaatactttcacccctttagaagaagctataaataaccaggtataaatgcaggattcctttccaaagacaaatactggaaacaaacacaatcaaggaagataattgattacttcaaaaaaacaattgagatatgagagtaaattaaataagaagactgtgactaggataagtaaccaataacagcccataacagctaacattattattattgttgttattattatgagatgaggtattttgccaggttgcccaggctgacctcagatactgaggctcaagagatcctttgctttggcttcccgagaagctgaaactacaggcagctgccagcatgcctggtctgcaatttacatcttttgtacactacagcacgttactgttcaaagcacatacaagtattaagctgcttaatccttgcaacactaccaagaagtaggagttattatcatgactgactctcttctacagatgaggaaacgaggcacagggaagtgaaaggcgtggtgggacagggacctgcggtctggatctgcttcatatagagaaactgggttcttaagaaggaaaatgggccttaatttctaaatcgtaacaagttcagccctcactcctcttttttttttttttttcactatcctggaaaaaaaaaagaagtggatagaaaggtactaataacaatgagtttaatttctcaaattttattattctttaaaaaggatacattggtacaggagtaaagacaaaaaaaatcaaaaaagaatcgagtattcaaagacccttgatggtgtaacatcaattattttaattttgtttttaaaatttttattttctaaactcctataataattgtttttcaaatggggaaaaagaacgaagtttttattactgcctttctttctacaatatattattcaatggagatactgaacctgtatttgctacaggctaaagaaaataaaataaaacaatccctagccaggcaagggagattttcagagaggatgccaacagggtcctatcccatcaggcatccatgacaaatctgtctgctgtctggtcctgtagcatcacccaaatgtggttcaggcagcactggaaacaatacagactcaggagatcagggaagtcattttgcaaagaagcagaagtgtcaggaggtagcacctgtaaggatgaatgctggagctgtctcatggagtttcacagaaaggtaacaagctgcacaatgactgtctaggggcaacagatacataggaggaaagcagtcttcattcaaacaggatactgagattgacatagtgtgtcttccaacaagataagcaaaagtatgtgaagaaatgagtccctaaaggaaaatatctctttgggcaatttcacttcaattcaatttcatgttaaatacaaaatacatatattgaatatgtggataaaatcactagaatatattcgtgcaataacatctacgtgagacatgacagcatctcaccatgtctggcagtctctcggggtcaaatgcaatctctgccccccacctggcagtcatcggcacttatggaataggccaggcagaaggctctgttagatactgccttcttcccttcgcaatgcactgtcccagacttcctggggtgagagaagtgattgtctatgagagctagcttggagtgaatgaaaacagcatttaagaggctcagcattttctgatcgccaaagggggtacccttcaacatgaggtgacccagcaatgattggctgctgagttctttgagtattttagggacctgcaggagatctgggtggagctgtgggtttccgtgtgtacagtgtgtaaacatcaccctttggtgcttcgccagtgcttaaggggctcccaggtgctatttattttgtttagtttattgttcagtgttattgtttgttgacttgatctatttttttttctcctacaaaggggccagtctgcaaggacacatcctgtagatggctaattgatgatgccctattgtttagtgtgtgtgcactgtggttttatttgcttcggttcaaagggcctaaacaatgcattcgttggaatttagtaactgctgtaaaatcagcacagagaacaatctgtgagctgatattttttgtacccaaatctggtaatctctgcttgactaaagaaagcaaaatctaaaatgacctttcaactaaccatagaaaaggccttccattgaatctcaaagagacttatttttctaccaaatataaaaacattcgaattatgcatcattttccatgattcaaaggagacagaggtgcctacggggcatgttactcatagacaagtctattctagtctaatcacgtccccttaaaaatcaccgagtagatgacaccgaggatgagaacgaggtactgtaatcattactttagaaactttatatttttacctgtttcaagacagaattctcctagaaaatctggagcaacaagcttattccccttggagaggagataacgaataatggaccacgcattcggagagaggaagtttccactgggagcccttcctgcatcagtgcgtctctggttgggctggctatctgtgtaggaagtgaacgcaggaagtatctgtctacaaaccctttatcctcaaggtaattgctgtagcagcattttactgtttaccaaagcagtaaacatgtgatctaaaaaaagatgttttccatctccagaagaacaaggctttaaaaaatgtatacatgtgcttattttgtaaccagcttatcaaaattggttacaataggcttgggctttcaacagtgagtccatgaaaacagctcttgggatggacagaggtaccctcacagggatgcacaagaaacaaagaagtggcttccttcactagaatgctatcctagcaacacacattttatgtcttttctcctaagaccggcttaaccgagttcatactgtttggcttacaaagaaggtaaagtcaacaaaactatctatgttaattcaggttggtagaatgagtaattcacaaagtccaataactcataaaagtcacttacatttggccttggacaatattcttatttttacgtgactataaatatgcttccagtttaggagttcacacaagacaaagtgaaaagttagaactcaaaaggagatgtgtagtggctgcttttgctgacttttgcctggcgtaggccaagcctcctggtccgtcttttcctttgtttctttattccagatcaagcttgcaaacctgcaccgtcccagatttcctggggtaagagaagtgattgtctaggagaggcagcttggaatgaataaaaacaggtccaggaaggatccctcagcatttaagaggctcaggaggggtccccctcatcatccttgttgtcttttgtgtttttcaagccgccttccaggtggatagcgattgcaatgagagagaaagagtatggaaggagaataagaagaatagggagacacagaagttaacaacgccctgaatgtctccttccaggacctgctgtgcagtgtccggtgaactcaccagcaagcatttcccagccctgttttaagcaatctccaatgcagatcaggtgctcgtgaataattgggagctcactgtgtctgtcagagttcttactttataatgaagagataaaaacatgttcatcacaggaaaatggacaaattggctaattgaaaacaaaattcaattcacaaactgttgtagaaattgaaaaaaaaaaggtagggggaaatgcttttcatagattccctgattttagtcttagaagaaaaatgtatttggcttgaatgaatagtaaaattaactaactttgattgaggagcttatgtgtgccatatacagttctgggctcttgcgacttggtgaatctcactataaccctgtgaagtaggaactatcactctacccatttcaccgatggaaaagcctatctcctgtgaggctgtggcttgccaaaggtgaaatggccaggaagtagaacagccagggagtgaaccccaaaagccaggtgggagcccatttcccctgcccactgcacgagacccctccccggtttgaagatccgataggggcactgctgttagctccccctgcgtcctggcagcagcacagtcagcagatggtcactgtggagaaggcggagctgaccacctccattttcctataagggagctagggccaggagaggtgcgttcacctggggaagtcctgcagcatcaaactaaagctccgggccaccctctcccagatgggcctctttccacttccccttgccagcagctatatctatgcctcccatccgttgcacggaagataaggccaatcccttttccacagaggctattttaaggatgccacgaagaaatacagagtaccaagtgcctccctgggccaaagataaaagtgggctgtgctctctggattcaaccttcatgtttttgatgctctctggaaggtcagggaaggcacacatatcgtatggatccaaagaggactacgcaatgcaaaaccacatactttttttttctttttaacttggagcaatgtcttgggacatctacctcaaattgagacacaaactaattgtgttgacagattctaaagtgttgtttcaacagtttcttcttcctcaaaggtgagcatcatgtgcacactgtcaaaattaaaaaaaaaaaaaaaaagacccaataaaacccgatgaaacccaaagagcatggagatgagaaactcactgctggctgacgatctgaatgaatggccttggggggaatgtgaatgtggaggtagcagaagggtcctgtcttcagtgcttgattctgtatcaatacttggtaaatttaaaaaacaaaaaaaccagcaagggagattttaaatcatcaaggcagaaggatttaaaaagtggaatgtgttaaatgcaagagtgcgggatctttgcataaagttattatattttcaaaaattcgacaagcattgtttttaccaaacgtgtttaaagtaacagccctgaggttaatgttatgattggattctgatgtggcactttaaaaataaatcattttgcttggccttagcatttcttttcaaaatgtctctgtacttatctgtgtacaacagcagattaccgttcttcccagagtttaattccatgaacaccctgctgaaagacttgttaaggccttatggaaaactctgacctgcgtgttcattattgacgcccaagacgagtgcaaggaagttgatacttgggatgaggaaatttaaatcagcagctgatctggaatctggaagcactgccccttggatctcgccaaatatggaaagaattcttgtcactgagcaaatatagaattcagtgctagagttttacctcttgaattttctagaactttgttttgattagccacctagagtataagaattgctgcctatgggatttttcccagaagagtagataacataaagtaaccagcgataataattttcattatccaattatttcatgtgtctccataacacttaatacatcatgtttctctgcacagtaattcactatgtacagctagggtgaatagcaggaaaaaagagatcagatgataaagagaagggagacagatttgtgtgacttgtataagatacttcgcctctctaatcctttgtccttatctgtaagaaagcagcagtacccaggctgctgtgaggatcacatgagacattatgagagtttagcacaggacttggcacataacaagcagttattaggatgatgttagtttggattatgaattcaagatactacagctacattttttatactttcttaaacatcaatttaagtcaattttaattaacgttattttactaggagaaatgtctctaaaaacataagaattctatttgaagtctacaatgataattacattactctgatatcttaacttcctctttatgatttcaaataattaaaatttaagtttatgttttcaacaagtgcttattgaacctctactctttgccagtcactgttgaggacacagaagaaatggataagatatcactaaaaacagcttctgcgatatcagtgggtatacataaattattcacactcaacaacaaacacaagcaaagctgggagaatgtgctgacaggaaagaaaatgaagagtgggagagtggacagatgggaatcgatgtgaaattttataaaacatgtcttggccaagctcagtaggggaaatatgtggaaagtaagctagaccaaacagagaataaaagtataaataagaaaaaaaatccagaggtcacagtggaccactagccaaaatgggttcacagcaaacaaacaaaaaaatgtaatgaaatactaaaattaaagaagtacaaataaaaatgagattctgttcttatctgtcagaatggcaaagattcaaagagtaaaatattcagagttgttatgggtgtagtgtggaactggtctcatatgtggctagaaaaagggagaactggtataatccttccagagaataatctggtaattattttttaaattggcaaatatttaaatttggcaaagacttaaaaaatatatatacccattggctcaataattcctttctaggcaccaatactaataaaaagtattcaaaaaattaaatagatggtgtactgcaatataatgagtgaaacatcgcaagcagcatcactttatacactaggatattggttataaaatggtaatacatattttagatagaatataatgaaacaaaaattttgcttatcaaaaaatgttagtaacatgggaaaatgcttgtaaaacaatgctaactgagaagagcaggacaggtaggtagatacaaggccaaacagatacacacggtggagagacatatcccaattgttaggaatttgctgtggttggttaggatctgaacaatttatattgactttgtgatgacttttaaacgttttctctaccataagaattttttatgtttataatttatgctaaagaacaagatgtattttttgtaattcaggagtaaagaggagagtggggtattccagggtgctgttcctgccctaaccaggagcacgatgcagtcataggcctctgccctcctccagcagcctcggctcagaacaggacgaagccaaccctctctgaccagcaccacctcgggcgacccctggacgctccacctgcccctgtgtgtggtacctgccctgctacacctttaacaagcacccctgcaagctccctcctccttccttccctgtcctgtggctgcccagacccagatgtaccctgcctgggtgtgggaggccgcacatcagagcagtctatggctgtgggcttcacagctgaagctgggccgtgggaaatgttgagacgagtgagtgcagagcctgaaagacaatacggtagaaaaggttacatccgcgggggggcgtctgatggcatctgccatttattgaggatgggtgcgagacagggtagccattatgatcccattttacaggtgacgaaactgagatcagacaggctagctaccttgcccagggtcacaacaggaaggaagcaaatgcaagtgtgtctgcggccacgtaaggtgagagaagcgctatcaggggtggtctgacagaatccccaggccagggagcagttgtcctctatcctgtggggtcaaaggaggggacaagaaggctctccttgaggtagctccaaagaaaagaccccgccagagcacagtgtgctaccaaacgctggaacagcctggagactgtccctgtctcttctctgaggtttctcatttcagagaaactctcatccgtctggcttccccatggcccttactctgtgattctcttatgtatcagctgttaaaccaataaatccgccaaattgttgggatgcctataatggctttgggtctccactcccacagagggaatcttattctaaagttctaaatgtatcagtcatattttcctgaagacaacagaaatggttgtttcatttacttatttttatgtatgctttttcaagagttgttaacctgtgtttgtgtttaaataaagatctgttttgcaaaacaaaaactttatgagataatcacttataaacgtagataattaagaaatggttcaggctcagcacattgtctgagagcattgcagtcctgcactgtatttcatgggggaagaaaagcccacagatggagccattctcaatcctgctttccagggtcactgagtcagggtgcctggcatgcatgggtgcatgcacacacaggcagagggccagggagaactgtgctgtgtccacagagggcagcctggatcacagagctgaccaagaacggaagcagcaagttgttttaaagtagttgcctgtaaagccacttttcggcaaggacaaacactcagagcatgctctgaaatgacttatgcacagcagggcagcggcattttgcccctggccttccttccattctcccggaatccccctaaagtaacaaggactgacgcaattcgtatttcacttagccaacaggttgatgaaaaatcataaatctgtagctattaaactcattaatcacatccatcaaaattctgtgaggagttaactttcttcatataactcttagtcttaattaagtttccctcacatgtgatagcaaacgttcaagaagtgcaaatgtgcagacgtggcgtatataatgcaagctttatgtctttaaattaataaaattgagtcctatcaggtcgtgtttcaattaccatcaaaccttccaacctctgttaattcaaaaaaaagtaacttctttaggcaagtcatggaaatagcactagggtgccctcaggtctccaccaagccttgttagtaactttccatgtcctgtctgatttttaagatgctttcccctgatgctgctgccggctgctggctctctccacatccttcaatgtcagatctctgtgatgatggaaaatcccccacattccctttttacacattaagtatctttctaggatcagaacttgcaacctggggttcatgttctccttaaaaggtccggggagaggactgtatttctgttgtaattctatgtatttctttttaggcaccagaaagtattattctgagaaaggactgtaggcttcactagacttcccaaattgcagatggcattaaaaaaaaaggaatcaggaaagtctttgggaaattaggctaaaactcctaactgaagcacaatcgagttttcagtgcaacagcaggatccctgcagtctgtagcaaacactgagatgtttgtggggacagtggggccggtgaggttcagcacctctcaatattgtcagatgtcaccaatgcccaagggaagcaccaaaaccaatcagtgaattgtctgcaaaccatcagctttgttgcttccaagtctttactagaactcttaagctgatcttaaaattcacagacacttagagataaatgaacactctcacataagttcccaaaattcctttacttcttccaattgaaacattttgttcccaatttcaagttaccaagggaaaatgatggtaagaatcacaaagactggatacgaatatttagcttttcatagtgtctcatagggtcttacaaatgttaatgcaaaaaaataaaaactccactcaaatgcagaaaaccaacttaaaaaattcagagcatctgatacctaatcgactaattgatttatttactgaaacaacaaaaaaacagagtgcattgagactggaaattgcctctatggggggctgtttcctaattccagtggacagccatcattttccctatgctaacttgggctttgcgctaacgtaattgaaactgtagtcaacagactcaggacctcctttttccactctataaacaaggctgtaaaatcatctcattactttacccaggaaatctaacagaaacatgtcttaaaggaagtcacctataaagagggcctattttaacagaagattaaaaaaaaattcacctgtagtcattctaagggttcacttgggtacatacaataaacacataatgcaatgtaataaaatgttaaatcaagcatagtaccttagacaagtgtaaactattatttccaaaaaagtgttcagaaaatcacaaaatattcaaactttcaaaatagcttcatgtattcataaatgtatacttcaaattaaacagtataacacatttggatgttttgcaaaatgtacctaccttctaaaggatggtctgttatttcaatgtcctttttaatgcactgagttttttgggaaaaaaaaccacataagatcgtacccaagctattcaagatttacacagaatatttgatttaacatgcatatgaataaggatgaaaataagaacaaaaaaataacattttgggtcacaaaatcaagtaatttctattcatgtagctataagtagggcacattaactctcaattttataattcctgtctataggagccatatttcagcagattccaatccttgaagccaaagaaagaaaagtataaggtgaaagttcttggtacacagatttttaatatattattgaacacaccttgagaaataaaagctgaacttctcaaacacagtttctatggtacatatgagtcaaatcttctaatacaaacatttcaaattatgaaaataccaaaccaaagagtatttttgaaaatggcttggcccaattctgggcaaacttccattttcttatgcactttccaacaaactaaaagccttatgaaaacaccaccaaatgcttctcacctccgtgcagcaaaactaaagacatgcaacaaacacaattttcttttccctccactcagcatctgcttttgttgctgatttttcacatttctacaaatgtcacgaaggcatggtggcctttaaaacaactgaacggacccccattcaagactgcatgccccttgacttgtagtcaccattaaattggcttcatttccaggaatcaggccatatttaggattgtacctgtgcagatttacctccacattaatctctacatgctatctactaaaaacttaggcaaggaaatgcatcagaccaaacaccccacagcacagagaaccgaccggccattgctttccaatctccgcaaacctaaccattgctggaagaaatcttactcacagtgcacagacagtaggtattttattgaagataaacatatagtggaacaaaccaaattacccccatttgagttacgtgagcactcagttctcagcgtggatgtcccacaaatcaagtcaacatttgcgtcccattaccagcagccacttgccgagtatctcttcgcttccactgggactgcctggcatccctgatgctaaggagccactgaagagcctccaaatgtctgacattcacaaacgcatcttttgctttgacccgacccttcaacctctccgagtctgctgccttttctcagacacacatccaggcaccgttagggatagttagagaatctgaaaattcagaagcgctccgaaaagcctttccaaaagtaatccacagcactcaacagtgaatttagaaaccccaatttttttctgagtttgaagtttttaagccttgcggatggttggagtaggaaaaaggaaatttactaggcagtgcaaaggaaatcttgttgtcctctattgtggcagtgggggtgttgcccaaccctaacttatctgccttgataaaggaaaccaaagaaaagagtaacaagaacaagattttgtcaaattaaaaggaaccctttccttaccttaatagtgctggccataatgcgatcaagtttattgatcgttaataaatgttaataataattattgcttctctctgaccagaaagtagttttgatgaggttgtttagagcggatgagattgtgctaagtctgggaaatgaagtcagccaatggcaggaagaggtttctattggtcctggctgtccagcccaaagaaacaggatatttgggagtggagagataagagaccctgaaaacaatgttgtttttcttgatgatatgcagccaggagattttttttttttaattaaaaaaagaaaaggcatcaattgggatggggactgccacagcaggtgtgaccggtgtgccgccgtgtgacacactgcactgagaccaaggcaggatgcagatgtgatgggactccgcatggcttcacacgggctgcaagcaccttggagccaaggcgttgagggcaccccactgccctgggtgtcagcccttcgcagcccaattcttcgcagaattactaggacagaggacttgagctcctttctcctaaaaggaaactttgcaggtggagtttatttcatgttaatagatggccatgttcagtaacagccattgcctggctgatttttaacaacctatatttattcaacatttcatataagtgttccagaacagtttcattttctccttccaaatacctgcactttttatttgctctacaacaaagttgttgaaaacgcaaggactctaggcttacagtaaacacaaaaaataaagaggaaaaataaaccttcctaagtcttgttttcaagtatttattaaaacccaaataactgaagtgactacaaatgtcccggaatatcagtgagctggtctcactctgacagacatccatgttgcagacaacagatcctcatagaacttttggctacccagagatgccatgtgagggccccattacatgtctaaaatccaagctataagttcagggtcacaggtctgttttctcctcgaaggaagtacagcgaatgcaggcctgaacattccttagagggtttcaggactttaattactcattttcaggaaattgcttggaagaaacattttgctttgaatctagctacaggaacgcaggacccataaagaggtgtggtctcaataggcgaccccaagaacacaatagactaaatcctgagtcatctgacaattcctggttgcagagctggacgttcagtaaatggatttcactcagactttaggccggcatgtgtcagagttctgtccaccagcccaggtcattctggcttttattatatacctctgatttatcacctcatgttaggacaaaagaaggaggagaaggagaaagataaggggggaaagggagaggaaggagaggaggaggaggagggagggaagagggcgagaaaaaatggagaaggagaaaggaaggacagaagagagagagaaaggaaggaggatgggaggaaggagggaggaaggaaggagaaagggagggagggagggaaagaaagaaggaaaagaaaagaaagagagtatattgtaagaaaatcattctgtggaaatcagaacctaagttctcagcacctacattatgagggggtgttgatttccgctcttttcatctctgaacaatgaataagatggcaggctgattaaaattctgtttccccgaaaatttcaaagtcctgagctgttttatctgggcagcttccactagaattctggagtgcggaggagaaaagctctctcagcttccctgagtgtccttgctttttgttctctcctaagaagcatcaatgtaaaatgttaactgtggcctccacaacacatggcacctgattatgcctttaccaaacaccagctttaaataagatgaacgctttgctaatgaaatagccacggaagaaaatcctgtgtggtcccgcctcacccacgcctcgtggttgctaatccagccctcagttgttccctgcagcaggaaagatcagcatttctactgggacctaatgcttcagtgatgatttggccttaactccctggttcttgcctaatgcaaatcaaactgtgaagagtgggatttcttacctctctattttgaaataatttccaacttacagaaaagccacaagataatacaccaaactcctaataccctttgcctggttaactctgattgtctactggtgccaatgtacatcattttctctgctttctctcacacatgctctctctctctcaatctctgtctctctctcccatatttatttatgtataacatacatgcatgcatatatccatcattttctaactaataaaaatattgttttataagagacaaatttatttattggatactaaaaaagagaaaaacagatgctattatttgatcaatattcgatccataagttttactgcgtctaattttggaaatgcatacaaacataaaaagtgatctaataaaaagttaatttggggatactgagtggtaaattctgttccaaaattttacaaaggaaactcctcctcatttctaatgacaaaatgtttgattgattcctgttgtcttcaaagagaataattcttgatgtttcaaatggcatcatagcatccaagcctggtaatctctgactatttaatgtaaagtgttttaaaaaaatctttggctcttgataggacaaggcacatcttttttttttttttttttttttttgggacggaatcttgctgtcgcccaggctggagtgcagtggcgcgatctcggctcactgcaagctccgcctcccagcttcacgccattctcctgcctcagcctcccgagtagctgggactgcaggcgcccgccaccacacctggctaattttttttgtatttttagtagagacggggtttcaccatattagccaggatggtctcgatctcctgacttcatgatccacccgcctcagcctcccaaagtgctgggattaaagacgtgaaccaccacgcccggccaaggcacatctattaactagaatatagcagtgcagaaaccgtttcccaaatattatcctatggggaaattatctgaagatatagatatcactctagctttcctcacttgtaccccaagtctatgttattaaatggcctcatccctacaccacccagcagcctaagaaccaggctgcctttcccacctgatacctcctctccctagggaaatatgccctccaagccaccacgcggaccaagttagggggcaatctggcacacggcccctacctgaggcccgtcctgccatgagcctatcagggcagggtcctttttcactctccttgagatgcagtaatcaccacactagaccagcacagcccatacagtagctgtggacagcagaacctatgaataaagcacacatttcccttgcatgcttctctgccacaaacccatcccctgtgaatctgccaaaaccttccactagtctcctcacattttactccaaagaaagaaacaaaataatataacataaatataccataaattcactgtcacaataaaagaaacactagtatttatttatcctaaaatcatttcttcccattttctaaagatcgaacaagttctcattcttgttcccttactaacttctctgtatggaatatggggaggaaggttaggagctaagaacactctgaatgacagccacatggttctcaatgtaatacatgcgcagagcaaagagaggagatccgtctgaacctccacatctgtggggacacaacagaagattcactcatgactcattcacgtctttatccctgccctatacatccctacaatggaacgcccttcctcctcaaaaacattgcaggaaaatgatgtcgtagatgaacacttagcaatatggaaaactgctctgatattttacctggttagttaaaaaatcacagtatataggagaattatatccatagactcattttgttaaaaataaaaaggcagttggggatggccgtgcattctgttccaaagcatctgtgaacctgaggaatagacaccatgagcgaagctaaccttcccgagttgaaaaatgaaatgcaatggtggcagacatgtccaaggaatattatggggactcgatccctttatgaatcttgtcatagatgaatgtgtggagatgtcaactagttggcagcagaacagtattggaacggtggtaatacaaggaaatagtatcatcatattagaaactttggaatgagtataaataatggctgttcaacagaaaaacccatgtcccctctccaaagggcctgtttcactatatgtaaaaattaggtcatgtatgttttcatattagactttttgttaaataaccttttttttttttttttttgagtctcactctgtcgcccaggctggagtgcagtggcgtgatctcagctcactgcaagctccgcctcctgggctcatgccattctcctgcctcagcctcctgagtagctgggactacaggtgcccgccaccaccctggctaattttttgtatttttagtagagacaggttttcaccatgttggccaggatggtctcgatctcttgaccttgtgatccactcgcctcagcctcccaaagtgctgggattacaggcgtgagccaccacgcccggccaataaccttttgtaatagtcaaaaaataaaaaataaataaaaaggcaaagtaaaaatattgacagctatatcttataataccaatggcagagaagctttttgttttttcccctcttcttctttggttcacttatattttcaaaacataaatttgtaataaacataaattatatcctaatataaaaatatgtaagtaacatgcaatgttgttcatttttgtaaatatctgaaaaatacaggcatgttctgtaaaaagtgcagcccacaatacttgtaggtgtcaaaccttttagcatgcccaaatgcctgttcttttttaaatgtctacagcaagcatagagctctttttttttttcattttattaagaaaacccagaaacgctcaagagtttcgtggaggccatctatgcggcattaatccattcaggtgatattaatggccttttcctgccaggaactccagtgggcactcaggaagccaggattacagggctctatccagtcaccgcatgtctcggcattcgggaagcctatctcagtctcctcaaattctgcacacataaaacttcagagcctgggagcgacccatgaaacgcaggtttttaaggacaaaacaataggacaaaagtgctgtatattgtccttaagatgacacatgaatttaaaatgcatagtgtttggattattcatgagagccccgcaagaacgatgtcccaggggtttttgccaggaacatgcctgagattgtagataagaatcaagcatctggggctgccgcacaatggaaaactccagcactccatggaacttttccatctgcagcagtcggaggatttgcctgagaacatacgcggcatgaagacactctcagccctcaagggcacccagtcagcgctgtttaaggacggtttttctgttcacagcatacttcatgattacagcttcactccattggatacaactatgtgagtatgtgtgtatgagtgtgtgagtgtgtgtatgagggtgtgtgtgtgggggggtaggggagtgccatatcccccagcagcacattaagaaataatccaattacaatttaaataaccattgtttcaacactttctctaagtggtgaatgtattcttcagtctcttggttgatctgaactaatagaaaccaaggaaactgttatcacataccaaatcctcaacttctcaacaccaagttgcaatttccttaatactgaagcacacgtcagttcagttctataagctcccatggagcaatgatttcaataaacacaatttcataagcatcccacacgttctcaagtttaggccaattttgctcttactcaactccatatgactttaaaaatgcaggaatattaaaaccattatcaaggactccaaataggtcaatgtattatctgtggttttaagaaagaaacctaagaggagagtaattattttgtcaccattatttagcttaaaataacttttaaatgtattgttccaattattaggcttctccatataatttggaaaccattaaatgagtttcaacttctttgtccgtataactgggtatatctgagcatagatgctacagacatcacgttgccattggtgcccataaggcttcgtatgcccacagggcatataattaagattcacaaaagcatctgactggcatcccactctacccccgactcagatccaaagtatcctttcccaggtactgtcccctgtcaccatccttggccaaattgagaatttatcccaggttgttgaaattaattttgattttgattctagtcagagttttaaatgattttttaagaagtgtgtcaatctcacctataagatactaaacagcatcacttatttttgtcttaatctgtcactattttatgaattatttttaaagaaaatacagattacttcttaaagaaagatcataagtggcactataatagcattcaattgatagaaattgatgtagaagcctgcattaataatttttcctgctgctttctaaagttggcttttagttttcggttgaggtgggctttaattcagcatcacctcatttgatgatttatttactaatttatttccatcacaaatggaatcagaaatgaagcgaaggcaaaaaatctttgccacaaattcatttatatttgcatgagtatcaccaggctacctgcggatgcaatgaagccctatacccgtgcctgaagtcaggagcacaggacactgggagtctgtctcagcgcagtaactgctacatggtacgctccacatggtatcctctccacctgagccctcctcatccctcgccccctctccacacctcaccctctccacactgtattatctcccactgcaagcaacgcagaggacacagaggtgcagctgaagtgaaggcaggccagttcttttccaattcactcttatgaaaatgtgttaaatcccgttaaatgcaccgacctgaactgaaatgatgatatcagtaaatttgttgttgtcatctgatgcccacacagatctcagcacatgttttgggaaaggctgcagtgttcaaggagtactagaaatgttctttctgagtggactggccatgataagccaaagaatattatagccgatagggataaatcatggttttcccactgcgcggttgcctggtggagattattccagcctttatttacagctacaaaaataatcctgcctcaaggattttaggaagcaaccacctcctgcctaaagaactacactgcattgttgacttgccagctagaaaccagacatgagtcgtgcagggaagttccctttgaacggcttgaattgttgtcactagagggtgctaaatgcccctcaaaaaggcctttagagagaatactagtgtgcctaattcttgatttaaattccttgaattgacattattttacaaagtggtctcattttttacttgttaaaattaagatctaacatttataatgcagaaatggtgtttttttttgaaaaatttggattgttcattattatagaacataaagaaatacacgttttaggagcaaacatgaattacacagatctgaatataagattaaaggcataaatctgggggggtgagatttgtccatggaaattgtataattgttttatgccactgttaatgattttaaagcctgaaaaatttaccactttacaataattttagattgttcaatatgttcccaaatgtgagttgcatcaaattcggtaaatgtagagtatgtttgttttctctgtacacaatactgacgtcagtgctagtgcctgcctaaactcagacaccagtagatccttttccagaactaagtgttataggaggaatatggattatactgtaatatatcagatgtgaaaaaagcctcacggtcccttcctttctcaaaaaaaacgtgtagtattttggaatatgcatggagtatagcacttctaaaaatggtactttatgtatatatgaagtaaaataggccttaaaacttaatatacagatttccttgaaaataatcttattatacatttacactgactttttggtcatccaaacattatgcacttaagcaaaaagaaatataaccaattttgcaactttcctcttcctgcctttgcttctacttaaaaatatctgcagtatttccttttctcgccgcttccactttggttcatataccaaggaatcgtgaggtcaatgggtgacagttgtttgtctgtgttcacggctgtcgggcggggctgggtgtgggtaaggctctgaccgacatctgaagaggcttcacccactgcggtttaggatacattttcctctcgctctgccagtagaacagggaggctagttttcaatgtgttctacagaaggataattaaggcagtgtgtcacctgctcgtctgctatttttaaaaggaaacaaacataacctttgcatgtgagaggcattgcaaactagatgggaggaggcccggaccctgtaacagtcgtacattccggtcccagcttcgctggggtgcaactgcagataaaagacgctggctcgacaaaaagcgcccctgggctctgcattgccagcatgcacaatacgaattgctaatgatgagctggcttaggtaggaactgaggaccctgagtgcagggctaacctctgcttcacaggaggggtccactggcgcgcgctggaggcggggagccttcgtgatatttctccgaagggaagagtccatgcagcatcctgataacagggaccttggcttcatccccaactgctcggtgaccccgatgcgtcatttaattcatttgtgccaatattcctttttcaatcaaccagtaactttgcaggtttgttcaaagaagaaattaaaatgcattggagatggaaggcagccatcttcccggagccccagtgctgacactgggaggggaaccccaggattccctcatgactgtgtcagtgatggccctcaacaagcacttactgaatgagtgaatgaatgaatgaatgaatgaatgaagccggccacagagcccaggagtatcaggggagagcaatactggctgtgtcagtggctagtccaggagagcccttcaagagcccagagttcgacttgaacttgggactcccctgggatgggtgaggttctctcaacagcagttgacaggagggaactgggacaggcccagccagtttcattcagtccagccagctgtggctcctctttaggaatgtggccaggcccagctgtggccaaagcaccagccagtccctcagttctgaacagaacgtgcccagcatcagtgccttcatttgtttttaaactgcctgctgaccatccacaaagttaagatgacagctgggacttaagttgtgaggaaccagtggctcccccatcactctctctcacacacacgcacatgcacacacacagagacacacagacacacacacatgcacacacacagagacacacaaacacacatgcacacaaagacagacacatataaacacacatatacacacatgcacacacatatatacacacagacacacaggcaaacacagacacacaatggatggtatcgatatctatgaacagatgagagagagagacagagcaggaggtcatctgctccccacccctcttctccccactgtcaccacctctctcccaagtctagctgcaggccctgtgagctgtggaagtggcttttttaagctgtcttcttagattgagtcattgggcagtgaggaaggtaaattttctctaagaagcctcccaaatctgtatcttatgggatttccgtctcaataattgagctaatagtacctgtaagcaagtggatagtcaataaaaaaaaaataccggctgtaagaacgaatgaatgaatgagtggatgagtggatgagtatacatcctctattttgctggcatcatgattattttacagcagatttatctggatttcaatataaaataagagctcccatttgtatacaacttagtccttgtaattttccaaagtaactctgattaaaattatttccagccaaactatttaggcaactgggttggtttcacacgtacttatcagaaaccattagaatggtatattgattgcatttctagacatttgccataccaccatggcaactgtatttcccaagatggcccagtaggatgtcccatcatgcataaccttctataaagtgacattgactttgcttccatcagaaagtgaggtccacgttcccactccttgaatctgagttgggctgtgactacagcagaagttcagctatgtggcttccaaggctaccttggaaaggtgatagagcttccacctgattttcttgggaacagccactcttaaacctcagccaccatacggggagaaagcccaagccatgtgacgaggccatttgtaggtgttccagtcatcagtcccagcccacagccagcattaacccccagaggtataaatgaagaaaccaagatcactccagccccaaccggcacttgactgcaaacctataagagactccaagcaaataatatctatctcagcccaatcaagccctggaaccatgagagattctaaataataaagtgatcattgtgattttaagccactgagtcctgcagtgagttgttatatagcaaccgggcatcggcataccatcagaagattccttaagaagaaacttttgcaacgttgctacagcagaaaatattccttctgtatgatcattcatccattcatcaatcttgattggcattgcctatgtgctaagcattgtcggtcactggaggtgcagaaaagaagtgaagcagtattcagccaaacaaacaacttgcatattggatagagagaaaaatatgccaaaattacaacagtattttgacccaacagaaaggacataagaagggaacatcaacagttccttcctattcttttccaccctttttctttctaggctcattaaatgtagaggtgcctcagggtcactttgccccatgagagtagataccctcctctcccatccctaactttggtcttcactctatgcctgataccagcagctccccaggctcctccatgctgttggcaccccattcccattctctggaaacatctcagcccatcaacctcagattactttcccaaggagatgtgagaaaacttcaattttcccctttgtgacttgcagagaaataggggtggtaaatgagaagcagagggagagggtggggattcattaccttgagttactaaagagaaaagctctagtgtttagaaggtgctgttattattttctctgaaacattagctcctagaaatcagaggctctgtccctagcatggtctctaaggcttccaggacgccccaggggcttccctcagtcaattttgactctaatgagagccatctggaaggctgcaatggtgggcctggctgatcactggaggggccttcgctgtgggcacagggacgtgcacaggttcacagagtgtgtctccgtttctgggaaccatggtcctgtgtgctccttccccaaagaaagcaggagaaagaaaaaccacagtcctgagtgggattctccccaaacatctaaaaagcttctttaaagaagtcaagttatcataattaaactcacatatggaatgcctatagacaacgtgttgctcttccaatcccagggagctaggacacccaaaactcacctcccagacggagctaggatttgagatactggattccacattacttaaagctgttcgagcttttcatcaggaatggaaagcattaatgcgtctcacacgtcactctctgtttcatggaattcttacactggggagctctttttattttactatttttctttaacagccagaacactgagaagtttgcaaagaaatttttcagctgcctttagtgacccttaactcaagaggttttgcctaatctgtaaattggagttgaaaatatttcagtacttttggagtggggagctttttgtctttaaaagagtggaacgacactaacaatagggctatacataccttgtgcttctttgtcagttactgcaaaccaaaaccagatgtgaagtatcagcggctacctcgtagtgacccatggaagttgaggctaatccatatcattcttaataactcaaaactgccaccttttaaccacctaatttttttctcacttacaaatgcaaaaaaaggaattgacagtacacattgaaatcgattttcccctgaccacttacagattttctcctataagagccaggaataaaagctcactccattatatcaagcagccatcatctgagtatgctttagtttaggtgatcatcacctttaacaaaccaagatctggaaggaagatttctgatctttaacaaaccaagatttgaaaactagatattcctgtcatgaccttttcccaacattcagtatgtaagggattcactggattattagactgcttgtaaatgtaagaaaacatagaaggtttagtgtgaaggagttagcaacctaacaaatgtttccccctgaattttcaataaccttcctgaatttaaaggtaatgaatataaatgaagaacaaaatcaatagatataggaatgattcacaacctcccaaatgaataaatcaatcattccaccctacatttgaacattcaatcaatattttgtctatttactaaatctaagaggaactactttaacataaaactaaatatgaaattatttccagcattgaatattgtgttttgccttagagcaggcacaaagtggaatgcctatgggtacaaagctaggcattgattgatgtttaatacctacaaatacagcaattacactgtcatgctacacgagacttcctattcctacactgaaattagactgcacatatgtagggataaaagataagacacaatcatatcatatttcctcaaatctaagactttgggtggtaagatgtaaagcacatcatgatttaaagtatcactaggaaagaaaaaacaattctgccaatgaaaattcaccgtaatactttctaatcaatcaattttaagatacatcccaatttttaagcaagaataaatgtgttaaaattaacacaaattggtacacttgtgatacaacagaagcactaaaatgtcacagcaatagaccacagggtttctcaaccttggcagcatcaacattttgggttggttaattatctgttgtgggggctgccctgtgcatggcaggatgtttgctagcattcctggcctctacccactagatgccagtaacacctcgcagactccaattatgacaaccaaaactgtctttagacatggccaactgtccctaaaggtgcaaccaaaaactgtcccagttgagaaccactggaacagagcaattcggttttatcagccttgtaatataattgtgtgtgtgcactgtgtgcatgacagactgtcagcctaatggaaggtatattgtcagatgggatagattgacctgaaaaaatcacataaaccaacagctggtacatatacaagagtgtgtcctgcccatcctaacccacacaatgcaaaagaacctggatgaccacgagtcaccatcacaggagtttactatccataagtgtaaaccatccaagaaaagtgaaaacagattaaagaaaataaaaataaataaaccaccacacaatatttgggcctagccagataacaacaatgaaaaaatgtaatattttgaagtattggcaagaatgtggaggaaaaagcattgacattcgtgtataatgggaataaaataatttatcctttgtctccgcaattgatattctagaaatctattttttagaaatactcacaatagacagttataagtacaaaggatgtctgctattacactgctcagtaacagtaaaatatgaaaatacactgtacgtctttcaatcagatattgaataattatactacacagtattaagaatgagatagatattaatgtactgcatagaaaatattcaaagtataataagttttagaaaattatcacatatgtatattagcatatgcagagaaaacatcttaaaatacaaatttcagttttgaggtttggatcatggagtaactgcccccttttcaagtcaaacagttgagaaaatttaggataaaacaagtgtgtgctacctttgtaatcagataaagtattttaaaataattcacattataatatagaaatactgaaatgccaagaaaatttaaatatattaattaaaacctacgggccaggcgcagtggctcacgcctgtaatcccagcactttgggaggccgaggcaggcggatcatgaggtcaggagattgagaccaccctgggcaacatggtgaaaccctgtctctactaaaaatacaaaaattagctgggcatggtggcgtgtgcctgtaatcccagctactcaggaggctgaggcaggagaatcgcttgaaccagggagtcggagggtgccgtgagccaagatcatgccactgcactcgagcctgacaacagagtaagactccgtctcaaaaaaaaaaataataataataggctaccaattagactttatagaatacataaatatattaatatagctacaaagaggttgaagcttattcattgagacaagagtatttattgagcatcgactttattaaatacactgttagtaagataacaagtgaaacttgttaaaaaaaaagaaactaggacaaaagaaatttgagttgagttccccaaaaacagggaatattcagattgtaggggaaattgggtaaaggatttgtttcagcatgaaaggagcaaggagcaaagaaactaaatgggaggttatgctgagaagtatatcagtatgaggaaatatcttgacatctacagacaaatatttgttgccaattcattttgggcattgaggattcacaagaataattaaaaacacgtaatataaaatccttctgattagagcacattttatggcactgcataaagagatggctgtgggagtcatttatattttaatactaacttgaacaaggcttggttctgcaaataaaacagaagagtaaatatgaagtggagcacataataatgttactgtttctgtgggtgagcttccataggaaagaggcaaaggcatcaatctcaaaaagttagaaaaacccaaagaaagaagaagaaaaataacaaatgagaacaaaattgagaaaattgtaaataatatggtagagaagataaacaaaaccaaatctggttctctgaaaagattagttatgtgtaagtcactggtgattacagagagaaaagagggaaggttaaaataaccaaagtcaacaataaaaagggggctattactacagatgctgtagacattggaaggataatagaatattatgatcaatttcctatcaataaatgtgaaaaattagttgaaatacataattggaaaatataatttaccaaaactgtcaaaagaaaaaacacaaaacctgaactcctataattattaaagacattgattgaaaaatctcagacctcttaaaggacaactccaaaaataaaaaaataaaaaaaagaaagaaagttccaggccagacggatttatcagcaaattctaacatgcatttaaaaaaaaaaggatgccactcttacataagcttttcagataaaagaaaagaaagcttgataccaaaatgtagctagaaaattatttaaaaaggaaaattatgggtcaatttcatacataaacatagatgcaaaatcctaaataaaattctagaaaacaaaacccaacagtatatacgacaataatatatattgtgaacaaactggatttattttaagaatgaaagcttgtttcaatcaaataatcaaatttacattgtaaagaaaatttatataactttaaacaaaagaagaaaagcacttaataacattcaacattcatattaaaaattcttagtaaattagaaataaagaggaagtttataaatcctacaaattgataaaaggaatctaccgaaacctacagtaaaccacacattttcatgtcaaaactttaaaatttaatcatttgaagttgggggaaaagacaaagaagccccacatattaccgcatttgtctgaaattgaattggcagtcttagttagtaaagaaggcaaggaaatgaaatgcaatgttaaaggattgggaaaaagtaaataaaactttatttacagatgacatcatttttttacacagaatttccaagagaatttggaaataagtcattagaattaataaatgagttttaaaagtttgctagatacaaggtcaatatagaattttagttttatatatcagcataaacatcaatagaaatcaaaatttttaagtgatactgttttcattagcattaaaaataccttacaatatggacataaatctaacataatacgtgcagaacctctacaccaaaaactacaaaatattattaaaagaagaccaaaataaatggatagatatattcatggattgaaaaacttaataatcaaaggtagaattttcttcaaattgatcaatagattcaatgcagatgcattcaatatttcaacaaagtttttgtgaaacttgagtgattctaaaatatgtatggaaatgcagagtcaaaaacagacaagatgctcttaaagaagagtgagaaatacaaaagattatcagagactattacaaactggaaaacctagaggaaatggatacatttctgaacacatacaacctgccaagattgaatcagaaagaaactgaaaacttaaacagaccaataacaagtaataagattggataggaaaaaaaatctcccaacaaagaaaagtcaaggaccagatggtttcactactaattctaccaaacttagaaagaagaactaataccaatcctcaccaagccatttcaaaaaattaaagaggagagaattcttcctaattcattctatgaggccaacattaccctcataacaaaatcagacaagaacacaacaaaaaagaaaactacaggctgatattcctgatgaacatcacttcagttcagcatggatacaggccaatatttctggtgaatataagttttctagtattttgttcagcaaaagctatcaacaaaatattagtagcctgaaaccaacagcacatcaaaaagataatgcaccatggtcaagtgggatgtatcccagagatgcaaggatggttcaacatacacaaatcaataaatatgatacatcacatcaatagaaaaaaacaaaaaccatatgatcatatcaataaatgcagaaaaggcatctgataaaacttaacattgtttcatagtaaaagctctcaacaaactaggtacagaagaaacatacctcaatatattaaagtccatacatgattaacccacagctaacattatactgaacggggaaaggcggaaagtctctcctctaagaactggaacaagacaaggattctcatttttatcacttctattcaatataggactggaagtcttagccagagcaatcaggcaagagaaagcaataaaggtcatccaaactggaaaagaagtcaaattgtccctctttggagatgacatgatcttacatctagaaaaacctacagactccaccaaaaaactcttaggtttaattaaaaaattcagtaaagttgcaggatacaaaaaaatcagtagcatttatatacccaataatgcactggctgagaaagaaatcaagaagaaaatcccatttacaataggtataaggaaaaaatatctaggaaaaaaattaaccaaggaagcgaaaaatctctacaaaaaaactacaaaacactaatgaaagaaatggaaaaggacacaaacaaatgaaaagacactgcatggtcatggatcagaagaactaatatcattaaaatgaccacaccacccaaataaatctacagattcaatgcaatccctgttaaaatattaacgtcatttttcacaagaatagaaaaaaacaatcctaaaatttatatgaaagcaaaaaggagcctgaatagctaaaggaaccctgaacaaaaacaacaaaactgggagcatcacataacctgacttcaaaatatattacaaggctctagtaaccaaaagagcatgatactagtataaaaacagacgcatagaccaatggaacagaattgataacccagaaataaatccacatattcacagccaaccgactttcaacaaaggcatcagtaacatacattgggaaaaagacaccctcttcaataaatggtgctggaataattggatatccatatgcgaaagaataaaactggacctctatctcttgccatatataaaaatcaactcaaggtagatgaaagacttaaacttaagaccccaaattataaaactattaaaagaaaatagagaaaacatttcaggacattgatctaagcaaagatttgatggctaagacctcaaaagcacaggcaagagaaaacagacaaatgagactatattaaactaaaacacttctgcacagcaaaggaaagaaaacaaccagcagagtgaagagacaacctgttgaatgggataaaatatttgtaaactgttcatctagtaagagaaaatccagaatatacacaaaactcaaacaactcaacaattaaaaagaaaacttttacaaagtgggcaaagaacgtcaatagacatttctcaaaagaagacacaggaatggccatcaagcatatgaaaaaaaatactcaatatcactaatcatcagggaaatgcaaatcaaaaccacaatgagatatcatcataccttagttagaatggcaattattaaaaagacaaaaaataacagatgctggccagaatgcagagaaaagggaactcttctacactgtgagtgggaatgtaaattagtacagccactatagaaaacagtagagatttctcaaaaaactaaaaataagactcaatataatccagatatctcactactgggtatttatctaatgaaaaagaaatcagtatatcaaaaagatacttgcacccacatgtttaccgcagcactatttaccatagcaaagacatgaaatcaacctaaatgtccatccacagatgaaatggtaaacaaaatgtggtacatatacacaatggaatactatttggccataaaaataaggaaatcatgtcacttgcagcaacatggatggaaccggaggtcattatgtcaagtaaaataagccaagcacaaaggacaaataccacatgttctcactcctatgtgggagctaaaaatgttaatgtcatggagatagagagtggaatgatggttaccagaggctgagcagagagtgggagtggagaggaagagagtttggataatgggtacaaacatacagttagatagaaggaataagttctgatgttgtatagcagagtagctgactatacttaacaaaaatgtattgtatagttcaaatcagctagaaaagaggacttgcaatgttcctgacacatagaaatgagaaatacccaaggtgacagacaccccaaaaccctgacttgatcattacacattctatgcatgtaacaaactatcacatgtaccccataactatgtgtgtgtgtgtatctatctatctatctatctatctatctatctatctatctatctatctatctatttatagtatccatttttaaaaggcaaatcttaaaaaaaagagtgaggtaggacaacctgctctactaaacatttttataaaggcacagcaattaggtcagaatagtgttcatgcaggtagaaacaaatcagacaatggaaaagaaaggaaagttcagaaacagattcacacatatatggacacacttgatttttgacgaaggtggcagttgatttttttttacaaaggggcagagtagttaaaaaagggagaaactgttggtaaatgatgctggaaaatgagaaatccacatgagaaacagaaacttgagaagtaactcataacatcacaaaaattgatgtcagataaactataaatctaaatatgacaagcaaaaactatgaagtttctggaacataatatagaaaactatattcctgacttgggaagggaaagattttaaaaacaaggcacagaaacactaagagtaaaggaaagactaataaattgaactgcattaaaataagaaaaaaattaggaacttaaattttcatcaaaagacactattaagagaatcaaaaggcaatgcatggagtggaagatgatatctttaacacatctaatctactattcatatccagaatatgtaaagaacccccatcaatcaataagaatacacacaagtcagaatacacacaaggaaaaacagggaagaaactgcacaggcagtcataaaagaggatatccaactgctcattaaaaggtcttctacttcattagtaaagcaggaagtacaaattaaaacctgaatgaaataacaccacagatacatcagaatgtctaaaacaaagactaacaatgttggtgaagatgtggagcaataagaactctcacacacagctggagtttaaaaaacatccttatttatccatcagggctgtaataagaggcatatagcatattcaaataggtaagtgaacaaaatttaatgaaagaatttacaacggtaaaggtagaatttagtaaaaaccaaagggtgaggaagtcccccaggctagcaagaacaggaagccattactaccctcaggcctacaagggcaagggaggtagcagtcacgcagcaccggtagctgtgaacacaggagaggataaacaataggagctgtggccttccatggagggaaaaagtcactgccaacccatgaccaaagagagaaagctggagaaaaaaactccccaagctctctcctcctactctcaggcttccttgtggtgactctcatttgcttaacccaacagaagatagaggacaaaggagcccatttgatgtagtcgacagaagtcaaactcccaggacaagaggagcagagaaggatggagaatgaattagagaagtaaacaaagaaagtcggcacatctactgtcatcaaagactgtgtaattccactatttaatacatgtacaatagagatgtgtgtatatgtgcaccagaagtcacctacaagaatgtccactgcagtattattctctcagttaaatgctatatctggctgcacaactagattaggactgagaccctaaccacacatgtagaagcagggagaaagatgcagttgagaagccctttgccatctgatatgcttccaaacaagggaaactcagcttggacactgaaagcattttgtataaaatactgtttgtatgatatccccatgtcaccacacacacacacatacagacacacacacatacacacacacacaacaaaaacaaaaaaaacttccagggttacttttctcctcagttagcaggtcaaaacttttcacgtgtgaaatacttttgcaaggaggcagatgaaacgggggagaagggataaccttgccttgcagtcatctatcaattcactgcaaggaaggaacacagagcttagatatgaagcatcaggagttcttcccaagacccttcttgtcccttgggaagagccaggagctggaggggatggccttcactgagaagtggcatcaaattagaacctgcacaacaaataggaaccagctacttaaagatccagagaagtagccctctagactgaaggatcagctcctcaaatatcctttttgattttgaactcacaagttcaggggcatccgaggaacagacacaagccagggctgaacaatctcatctgtgtccatgaggtgggcaagagccagatcctactgaggagtttgaacttaatcccaaacatggcgggaagccattggggccaaagatgaattagggattgtctgatctccttgacacgttctgaaggttttgtgtacagaaaaggtttgtcaacatgcacaaaggaaagctgggataaccaagctaagacgctaccgcatcattctaggggacgggtgactcattccaggagtttctgcaggaagacctatcaggactggtgattgactggaggcagagagcacgaaaaaagaacaatcagagatgatctgtggtttgtggttgttgtgtaatgttaaggcttaacaactgcgaaaatagtgtttttactttacagagaagaagacttgaagaatacaagattggggagagcagatcgggatttgtactttatatcagacgtgctcatagatatacatgttgagatatcagttgggagctggatatatcaggattcgagactgggaatcaccagtttatagatggtttttaagccatgtgattggatctcatttcttagtggggagaagtgagataacaaataaaagccaagattaaagctgaaccttcagcctgcccatcacttagaagcccagcagggacagaagagccagccgacagcacagagtcgaggaggaggatttccgggcttcagtgagtgtgcatcagagattcatggacacaacttaaagtaagaccagccacacagttcccttcattttctcaagcaacattcagcatctcaaagtgcggctactacacacggagccaagccctggtccagttatcacaaaaccttactagatatgtcgattattagctgcattttatagctaaaggtaggcaggcacagagaagttacgtctcttgcccacagtcacagcaagcaaacagacctcagaccaaagtctttctaactccttatttcacatctaaaacactatgtgacgccacctccaaaaaatgtgggggttactctaggacaaaagaagctcatgaaagcaaagagagaagcatagagcttaaatttagaacaatattcagggtgattgggaaaaatagcctccatacaaatataatcggttcatcaccaggtgaataaaatgagagaggaacctggtacaagtgaagttcattgaatttgcttgcaaaaaaacataattcaagtgtggaagtttggaaactaaaatagtaatcagctaaagaaattttcaggccaacttagacacaatggtgacaaagctcccctgaggagacaggaactatactacttgcaactctaactgaatggacttaacttagcaattaagatcaccgtaagtttgatcagataagtattaaagggtgtcttgggtacatttgcagattcagacactcttagttgtgaaattcttcaccaaaaatttgcaacttatggcttgcacattaaaaacatgatatgaatgaaattcagatatctcttggtaaattttataattattcctcccatcagctaaagttctcagtatgaagggttataactgatgtcatatacaataactacaagctgtatcatacaaaaattgagaattttctattatagaaagagttgctttaatctaaacctaaagtagcatcaataatttttcgtaagtggtccccttcctatgagtaagcccccaggaaaaataaattgcttttaagaaatgctgtaagtaagctgtttcatatataagttttgacaagatctggctacttaaattacaagatataaaatgagatttgtactttttctcaaatgtaaaaaaaaagatttacttctgaaataatggtctttataaaatatgcatttttgttcctttttcttatcatatctataaatttactaataaaagattctatcttgatttactaacatttgaaaagattgattatattggtattgcaagaagaggataccataaattaaaaatccatatattaaccatattcttttatttgcaatatgacaaatgattgtgtaaagttataatcaataaaagctatttgaaagtcataaaatggatattgccataactgctttcctagcaaggttaaaacactttaactatttttaatcaacttacagtgtagtagatcaagcatatctaaatattttattttaatcaagcaaatatatttctgctgttcctatgacagtatgaaagtttggttcaaaatatttccaaggtatttaacacagttcagtagaggtcctgtctcataaatcaatttcagattagataaaaggaaaaagcaaattcttgtttacttcagaatttttcaagccagttccaaagacagagttgttactctcatgtgaattttcagtagaaagctgaacaacgacgttgctctgacaatctttttaaataccatatgatggagacagaataacaaaaacaaagtaggtataagctgtacgaaattatttctcttggacataaaatatgtttggggaagaaatgcattgttccatatggactagggtagttacttctcaaagtgggagcaactcagactctgaaaaatggtttctcaaaggaggcattgtgtctgggtgaggccagttttctagtcaaaatcattttattaaatgccattggattgaatgcttccaggtttgctctctgaaatatgccctatcattcttaaaaaacacacttaggtagcaaaaagggcacactaaaaataacgtgggttaatgtttctatcctgcctgtgttttctaagtagcccctgcctgagctttcgacttttttaaatgaaccatcaaatagttggttgtctatcacaaataagccatctattttgttattcctgtaactttttgtagaatccagaaagtaacattcttgctgatatatcttatataacaccaagtccattttccaaatgaggattccaatgagtattcatcaccaacatctccccgaaaaatatttagaaaaaacagactcaatcctttatccaaagtcagtgagtaagaggcgggggccagggttggacaaaaatctctttggccaggaagccggtggtcaccctgatctacttctctaagctcccacccctgatgaatgttcaatatctgagtttcaccccactcattattgtaattctccgtaaaaccccagttacccacacggaattctcatctacatctagcccaatttgctactggatttcaatgttatttcatatgaaaacaatcactaacagaaagaacctggatctggtttcgaaaacataatttgaaaggaattcattctgaaggctgcaaaagcccagtgatggcccatcggtaccctgaatgggcttctcaggtgcctccactctcctccgtatgtctccatccatctcagaatacatgtctggctcttcctgctcataaacagaaacagagagttccgggatccaaaggcaagactgcgatttaagagacactttgtttttgtaggtgttcaaggatttggaatcaaagcagcagaattattaaaattaatccaattttcttgcatttattttgttagttcatacctctaaaagatatattttggaaggcacccttcaacccacccatttacaaatcaaagctttctttggaatccctgagaccaaacccaagctagacagtgacacactgccagctccagagccctgcccacctggaaggggtatggaatgcactatttgacttgagctcacatttaattacagtgtcaaaaatcaaacttaaattgctttaatcagctgccaacactatgagcctttctggcttgaatttctataaacaaagaataaattcaaatctgtcacaaagtggcagcaacttgttgaccactggactaggaatcgttatgcaaccatggctcactgtggaaaaagtcaacatcttcctatatgtgactcttttctgatcttttcggactattagtcaacagaatcatcataaagctaaattatctatctgcactgaaattactcagcctcagacatccaaaccagtagctgttcaccaatgaaacctgaataaagctgttgctgactttccctgcttcaatttagagtatttttggaaacatcattgcatgtttaaaatataataagcaaaaggacctttggtaattaaacattctgtaatttaaaactccaagagacaggagcagtgataagatattagattttctttactggggtgaaaaagacagaaagtggttaactgtttaaaaaaagaaagaaagaaagaaatccaaggatttttagagccagaaacagtaacagtgtcctttattctggaaatgtttaaaagcctgtaagcagagatcacccagttcatcctgagcattggtgagcaaataacttctgaaatgctcttgaaagagaattctccagccttctctgtttgaaatacttcctaaagcaaacacaaaagtgggcaaaacacaagagctcatgttaattccaaacaaagagaccaacagtcgcaaattgagagtccatcttagaagcgggtgctgcttccacatcaagcaactattggaaagagtaggggtagatgcagaattaagatcatttgtgactacagaaagagacaagaaaattaatttttaaaactaaaagagaaatttatttcagataatccaaggaaatgagcagagtcaacctaacaggattctcaagcccctccctactggtgtggtgtgaagatcacacgtggtgtagctgacacccctcacatcttccccgcgcccctcctgccacctctttttggcattcaccctctctcgggttctgtatccctgcccatgttctccatgaaaggccatgttaatgcccatgctctttcctgcctctaacagacgatgccttccacagtcactcaagctttaaccctcttctggattcggacctgtacatccaaaagcctgccagacatctcttccagatgctctcagagcacatgaccagaagcacgcgcaaagctctcctgagcctcagtgctttccctccaacacttcttccactctctcagttaccgagccaagacacagagttgcttgtgagtcatttctctacctcatcccccacccaaccttcctgcgagatcctgctcacgttacctcctaaatgctgttacgtgacttcaaccacgtcagctttttatgggggaggagaggcacctgcatatctgtgggagcaccaacctctagacatctcctgccaagttactgcaatgtgcagaaaagaggaagaaagcaagcccaagtcgcaaagtctttgccagtccttctaccaaccacaccttcggtggagatgtgggtctgtggaaatgcagagacggactgaaagccaaatgggccaatgagagctctgaacaaaacattaagcttgtttttctttaaggcaatacgattaacagtggtccattaagaatccgtttaaaaaaaataataataatactttttctgactattgttggggaagaataactcctttatggggagtatgaactcaaagacatgatattgtaaaggaggccttgaagaagagagggactaagaaatgtgatggcgtggtctgttacatgtgcaggtgctgtgtgtgagggaagcactgaggaccactggaggatgagggatgctctgtccttctcgggtatggctgaaggacagggattgcccatcaaggagtaaataatccatgagtggactaaattctttagaaacaggaactcaaatccagtagggattaggataaaaatgtaaactctaatttgcacctctccctctctcccctaagtagtccgtttctataattttatactaaatcaattaaatgtatctgctataatattaatcataattttgtctgaagtagtaacaactggaaactacctaaaagagtcagagcaggactgtaagactatattgtagtctacactatgtcacagcggactgcatcatgatagagaacgatactcatgatttaactgataaacacatatggcaatgaataaaactgtgagtaagatgtctttaattttagcaaaattatcttcattctaattttcaagtaaacttaaagatttatatataaatgcacataatttaattaaaatacatgcatatattaactagaaggctaatcccccaaaatgtccatagatgttatttctgagtgaggagggtcaggaaggttttaattttctttgtactaactctatttactaaaatgtccacctggattaacgttataataaaaatgttaccgtttaaaataaaatgaataaaatacaccggtatgaaggtattattagaacatacgaaagtacaaaatcaagcagcaaaaggaggaaattatattaagaactgaaaaaactatgttgagaattctgtctaagaaacgctgtagcaattaagaaaaatcccagttctgcaagtaatgggagaaagatgatgacttccagaactttcaccatctactaagatgttcaccaattcctaagaagggactgaatacgtctgcatcctcagatctgagagtaattttccacgacgcatactgagcaccataatgagtgaagtctctgagatgacctctctgacctctctaaaacaatcaggcactgcaaacatggcctatcccacactagcccttggtgaaattcaagggcataatattagactgaaacagtgagaagaagattcgacatggagtgcggcaagaatgtgttctagtccttgaaggccagcgctattccaagtgtggtctcagaccagcagcctcagctgcagctgggggcttggaaatggaaacgtatgtgctacgtcctggacctgtggaatcagaatctctgaggtggaccaggaatctgtgtttttaaaaccctgtggttggtaacttcctgctggctgaggacagagagaatgcttagtgaacgctgaggaatgacgggttaaataatccctgaatgattcctgagcggatcaatttctcagccagagttttgaccgcagctgatgatgaacagggctgtgaccaccaggaagggtctgaagaggaggcgttgattgcagttttctgcctctgatcctcaggcatggagccccaccccccaactctcttacacggaggccaaagaaaaagctggaattctccaggagagcaggacctgttaaacagcaaagggcaacccaaaattgtatgagtggccttgccctgagaagctttgaagccagaggttactgaacaactaccctggttaaaaccctaacgtgacaatgataacatgtgactgtatgtggctgtcttcaaaacagcaatgatttaggcacaactgtggatctcagattgttccgtgagtttggtctgataagattgtatgcgtttcccaggggtgccataacaaagtgccacaccctgggcggcttccgccaccgaaatgtattttctcacagctctgaggtcgaaagtccaagatcaaggtgtcagcagggctggttccttttgaggctgtgagggaggatctgttctaggctctctctcccccagcttctgggggctgctgcagtctttggtgttccttggcttatagaagcatcatcccaatctctgcttttgcgttcacatggccttctcctcatatacctgtctgtctccaaatttcctcttctcataaggacaccaagcactggattaggggcccaccctactacatctgcaataaccctatttccaaataaggtcacattttgagggaccagctaaatacaaaacattagccaggcatggtggtgggcacctgtagttccagctactcaggagaatcacttgaacctggattagaacttcacaattactgacacgattcaacccatattaggttgtttagtattatacattaggaagccatagcaaacttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcccatagcaaacttttgtaaacataactatttattaaaatttggtataattaatatttaaatatcctttctggcaagatttagccagttttttaagcttcattgagagaaccacaatattagcattaataatagaatggtctattaattttttaaaaagatactatgtctgcatttccaatataaaattcacagcaatgattcaggtagaaattaaatgaggatgtcattgtcaaccttttaaattatattacaggagcagggagcacacgggccctgaggtagaaatgaataaggaatattctagaaccaccaagaagccagtgtggccacagcagagtgagccagtggtgctggaggcaggtgagatcttgaagggccttggcaacatgaacaggagcttggattttatccacattgccgagggaagtatgaggtggtgtttagcagggcataaatctcatctgatctgtactttgaggaaaacactctgacttctgtgtggagaacagtctataggaagccaagaggagaggcagggagatgagggaggggtgacttcagtctccaggagaatgagctagtgatgtgaattaaggtgctggtggtggaggaagtgaggtggagaactggacactgggatctattttgaagagggagcctacagaacttgttggtggatggctatgagggaaagaggattaaagaatgatgctaggcatttgggcttaaacaaacccctgagtaaatggttatcctattattaatactaagatgggtaatgctagggaaggagtagccttggggagcagtgatgagttattttcttagagagaagccacgttacctataggaggctcaacagagtatcaaattagaataaaatatctaatgttctgatttgtgtctttattttttccattaagatacacatggctggccaggcgcggtggctcatgcctgtaatcccagcactttgggaggctgaggcaggccgatcacctgaggtcaggagtttgagaccagcctggccaacgtggtgttaccccgtctgtattaaaaatacaaaatattagccaggcatggtggtgggcacctgtagttccagctactcaggaggctgaggtaggagaatcacttgaacccaggaggcagaagttgcagtgaaccgagatcacgccattgcactccagcctgggtgacaagagcgaaactccgtctcaaaaataaaaataaacaaaaaccatgggaaagaacaattgaggaaactggggacttgtcctggaacagaagacacgaggacttttggttttttagttttgtttttgtttttgagacagagtcttgctctgttgcctgagctggagtgcaatggtgcgaactcagctcactgcaacctccgcctcctgtattcaagtgattctcccacctttgcctcctgagtagctgagactataggcgcacaccaccatgcccagctaatttttgcatttttagtagagagagggtttcatcgtgttggccaggctgtcctcaaactcctgacctcaagtgatccacccgcctcggcctcccaaagtgccgggattgcagaagtgagccactgcgtccagcaagaatgaggtttgaagggaggcatgattgtgttctcttcaaatagttgaaaggttccatttgaaaaagggatttacttattcctatggttctagtaagttgcagagggtggatctaagaccattgggtgaactttacagagaggccagaaagccttctccaggggaagaaagtcaagaaaaggtctcaaaactgtctggcagaattctgcacaggagagtcctcaattcggtgtagaattggcaagtataataactgtaaatccctctcaatctaccatctacatcattaggcgacatcttcatttcctgaaaattccaacacatgaaggctcacttactatcaagatgagcaagtttgtgctacatagtgaatttgatttcaataggactcattttataccttttaagagtctttaaaacgttgaaaatgtaaagatctgcaagagcaactgatcttcaaagtcccgtcgagtcacaggattttgtaatgatgtctaaagaggaaaattcccatttcagaaaaggctcaatagtatttaatagttagctcaaaaggacgaataaagttctacatgggaagctgctgaactacagtcaggccaaaccttcatactcggagaagatgactgggcctgtagacacagatattgatgataaatcatcacaaaccacagctttccttaattggggtggtgggcagggagagcaggcttcaggttggccttcctccagcaagggcacacacacaaaggggacctgaacacgtggagcttatggtcaggaagcctgaagtgcctgacccagcacatctggtgactagtagtgtagattccccacagaaggaatgacaaggcgtcattattcaaagtgaccttccctccattggaataatcagaaacagctcacaaataaagtaatctgtaagatgcttcatcttctctaggtaacctctccccaacatgatgacatcacttcacatgaggcgacatggttttgtgaggacttttctttccttccaagtttggaatctggctgaaggctaaaatcaccatttacagtgtttgagccctccttcacactttgaagaagggtctgtgtaaatagccattcctacttctcagactcgccagaggcaaaacctgttttgctttggtagtacacgctcttccttaactggtaaaagactttaaaaaaaaataagatgccatttttaattgtttcataaatctggcttagatatattaaggaaattgctattttatatgtagaacagcggcaagcaaatctcaagagattaaaaatcatgttcttgtggttttcttttagaagctgcaaatttgaattcaatttaaaaaatcatggcacagggacaaaataagaatgaacaaagatgggaaaaatgtccgcagcattctgcagagtcaagcgctgctgtgagtgagtgtgcatgtttccaattacacatcagggcttggcgagctccaggagtcaaattcagacagaacccaagtgcagtgcgttacacagaacccaggccaggaaaagcttcacagagtctttctttcaactgaggcaattgtgtagacaatttggttcatttcaagaaaaaaataaaactgacagaagaaagaaaaatattattatattttgcctctcaaaacaaagtcaaattgtgttggtgtataaatcaagattcagtatttccttggctgcttccagaataatagtagatcacaaagagaataagaacaagaaagttcagttctcagccagacgatccaaggtaacaaagggtgagaccctcattccgttactcacaggagcaaacagacaaccaataataattgggcacatgggggtttcaacaagataaactgttatgtgagtccagggtgctaatttctggattcttttgagttgcaaggaaaatatataccgattccccacccccacccacccacataacaagacacaatagttaacagctggaagactgtggttagggggaaatgtgattgtaggcttccatttcaaatgatggaaaatcatttctgaagtcactacgaaagttacttcacaaaactaaaagaagccttgacaccttgtgttatcccatcatctaaagcaattctagtttggaaacacttgattcttggcaggggattctaaagaaggtgccgtatgtgaaaggctggtgtgtcagaaggagctttaaggaactggaatgagaacagccaaaagctaagatttctgattataatcacaggtctggatgtgttcaaggtaaaaagagatcatccccatcatttgcaatattttcaagagaatggggctttagtgacactgatcaaagtctgacatggattttcagctgccttccaactccacatacctgcaattcaatgatctctatggatagtagaagtaactgccaccctgatgttctcatcggtgatttatacgtgaagtggactcaaaagaaatacaacgaaatcccttaataaaaattatgtccattgacccaacaagcttcccagtgctgtatcagttctcaaccgattttagagacatttggtcaaaaatgatctacttgtaataagccatctgagggcactagctctttttcacctctgtgttccttgaagcaggaagtcagtaaaatcactattgaattaaaatgaagtaaagcactttgagatttcagatttctaaattaaggaacacacaacatacggtactttatttgcacaagaattattagaacccagggctaacacccaaatgaggtcacaggtaaatgaaaatctgtctcagttatttgaactcaggtcaacacacagacagagcaaagcaccagctgacctctgatgcacaacccagtgttcttaccatagaattccagaaggcatctcagtcattctcttatgtaaatacaaagacgacaactggtttaaaaattcatttatttttattttagcttctttgtgtcaaactcaaagaagcctcacataaatgatcaaagactttttggtggatcttccaaacgtacatgccgggaaggcctgcttgcactttttccttcaatcctctaaaatgaaggttttgaagatgcttgccaatggaacgttgtgccttacagctataatattttttaaaaggcattcagtttaaattaatatatttggccagacaactgtattaaaattcttgttgttttttctgttataatggtagcctgtggtatgactagtcttcttcaaaaatatgtacagttattgcttctctcttgcctggggtatatcatgtgtttttcatttgagtgtacattgcaatacctcattaaaaccaacacttaggctacacaaaagtcttcatatcatgccgcaaagggcgtaaactaacgtggaaagtttcagagcctcataactcattgcatatacctcttatactagctgctcaactgatatttagctctcctggatgatgtcacagtttttatcctcttaaaatagcctgccttcagaaaatatatagtttccttcatgcactaatcatggggagttacgatgtaaatagagccattttttttcttatacaaggaacaagtgctctcaccctcctcccttctctccctccccatacacagaagcacacttcacttcacttatactaaacacttcacttatacttacactgcaacaaagagttgcaaatacatgcaaataaagcctttataactcccctctctcctgctggacagctccttgactcaagtatttccgaagacagacactctgataagggtctgctctgagcttcattctcagcatacagtcctgggattatttacctaccaatattcacctctgcatgaaccagtaagtcattactgacaagaaaaaaacaatttgtgattttttttaatgtcacaatttttctttttaaggtttgggagagaaagttgttttgaatgtttcatcagtttctattgccaaatgaacacctgtttcagagtccctgaaagtcacacatcagaagcttctgacttcaacatatagtctgctttgaagaattattttaaaaaagcattgactgcttgaagataagcaagtgacactcaatagcttcattctttagtcttagaaaataatttttacacttcacacctattaggatggctactatgaaatataaaaaaaattaaaaataacaatggtggcaaaaatatgaagaaattagaacccttgtgcactgctggtgggaatatcaaatgatacagcctctatggaaaacagtatggtggctcctcaaaaaattaaaaatagaattaccatatgatccagcaattctacttctgggtatatattcaaaaaaatttaaagcaggatctcaaagagttctttgtacagccatgttcatggcagcattactcacaatagccaaaaggtcaaagcaacccaatcgtccatccacagatgaatgaataaacaaaatgtggcatacaataaaatgtcattcagtctttaaaaagaagaaaatttggacacattgtacaatatagatgaatctttttttaaattaaagtggtttttttaatcgttttattttaaagttccgagggacatgtgcaggatgtgcaggtgtgttacataggtaaacgtgtgccatggtggtttgctgcacctatcaacccatcacctaggtattaagcccagtatgtattagctattttccctaaggctctcccacccccaccatcccccaacatacaccatagatgaatcttaaggacattatgctgcgtgaaataaaccagtcacaaaaagacaaacagtgtatgattctacttatgtgaggtacctagagtagtccaagttcagaaagtagtaataatggttgccaaaaggtgggagcatgcagaacacggggagtgttgattgacatcaagtttctgttttgcaaggtaaagaagttccagagatttgctgcaccaacaatgtgaatatacttaacactactgaactgtaaagtggttgtgactacagattttatgttttatgtgtttgccacaaccaaaaataaagattaaattaaaaaataaaagattttatagcacctatcacttaccaaacccactgtacatcttacactcgtgaatattttatgattttcaaaacacctttatttttttcccttatttgttcattccttcatgtataacccacaatgtgttaggttatgtgctgggcagcctggaagacccaaagacgaattagggaagtaccctatatttaaagccttgcaaggacataaatatcagtaatataaagtaaaatatgttcactgctgaaaactgctatacttcctagatttttcaattcaattgcaatttctaatattttgccatgttgatcccacaaattcacttgtgtttaaaagttaacgtgcttgattatcatacagctgcttctttcataagaggaatacagataaaacgctatgggatttcagggggagaaagaacttcttattaaattcatattttcaaccaataagaaaacacaattttttttaatcaacactatcttcttggtgcttttttcacatctcatcctctttcctcctttaccctgcctaagcaaccatttctggacccaatcttgggttattacatctgacggcaagtgttatgtgggccatggaccatgagcaattagccccctctctactcctagggatggagtacatgtgatgatttccatcagactcagattaaatatcttgctggtaagttacccctaaaaatcgattaatggactctccaggtagacactgaggtaatctccaaccaaacctgacttatacttaggggctttggaagcccaccagagtcatcaagccatatctccacctaggctctatactggaaagctggtcagtagtaacacaaagaacaagccatttgggaaaacagcccacatgaaaagaactgtggtttcaagaagagtcattccatcccaggtttaaaatactcttctcctctttatctaccttgaggactcctatctatccttccataccagatccagcctcatcttctaagtgaagccctcctctgggacgtcagcgtctcctctgcatcccctagcattttatgcatcctctgttaaagcaactgtttgcacagctgtatccaccactaaacttagaggcaacagaccatggttttgaatgtgtagaacccaacacagagcccgagacctagtgggtattcagtgcatgttgaagggaagaatgaatgcatgagcaaacaagacaatggaagtctgtcatcagtatttacatttcaaaatgcaaagtgaaaattgtgcaaatctctaatcaagctgtactttaaaatgctaaattgatttggctaaaaatatttcaacactgaaatttctttttgcaagttaagtcttcgcataaccaaaacagaaaagaacgtatcaatgaactaaatagataaatttatggctgacaaaatctcaagatttagtgtgtgagaggaaagtaaaattcaatgtgtccttgaaagttctggggtctaagatatacaggccaatggaatagaatagagacttcagaaataaactattgcatatatggtctgataacttttgaaagtggttcaaagatcatttaatgagaaaaaaaggagtcttttcaacaactggtgttgggaaaactgggtatacatatgcaaaagaaaaaagttgggctcttaccttatactatatacaaaaattaactcaaaatagaacaaagaccaaaaaataaaagctaaaactctaaaattcttatgagaaaactctaaaatgcttagggaataacttcataacactggatttcacaagcctgtcttgaatatgacaccaaaagcacaggcaacataaataaaagagacaaatttgcctgcactaaaattaaacacttttgtgagtcaaacaagctatcaacaaagtcaaaagacatcctataaaataagagaaaatatctgaaaataatttatctaataagggattaatatccagaaaaaaaaatatatatatatatgtatataacctacaactcaacaacaacaacaaaaacaacccaatttaaaaatgggcaaaggacttgaacagaattttttccaaagataacactaatggccaataagtacatgaaattatgctcaacatcactaatcattgggaaaatgcaactcaaatccacaatgaaatacttcgtagccattagtatgactattaccaaaaaatcagaaaattacaagtgctggtggagatatggaaaagttgcaaatcttatgcactggtggtgggagagtaaaatgggaaagtcactataaaaaacagtctagtgattcaaaaattaaaaatagaattaacatatgattcaccaattccgcatgaagatagcaggaaattgaactgatatttgcacatccatgttcatagcagcattatttacaataaccaaaaggtggaggcaacccaagtgtccatccacagatgagtggataaacaaaatgtgatatacacatatcatgggatatcttcagccttagaaaaggagagaaattctgacatatgctataacacagatggacctttggaaagttaagagattgtcttatttatcttacgctaagagaaataagccatccacaaaaggacaaatgctgtacgattccacttgtgtgagttacctagggcagtcaaattcacagaaacagaaagtaaaatgatggtttccaggggctgagagaagggtagaatggaaagctattgtttaatgggttggagtgtcagtgtaagaaaatgaaaaaagttctggagatggatgatggtgagttttgcaccacaatgtgaatgtatttaataccactcaactgtacactaaaaaatggttaggatgataaattttatgtatattttactataacaaaaagtcataaaaatcaaacatggttcttctcattaaaaaaaaaagaagattcctgggtctagttggttctccctccttcttagttcttggatcaaggagatagaattgtgtccaaagtgaccaagtgacctacggagtaatgggcttccatctagccactccctgctttatgactgagctgcactgggagaggcattgtcaggggaaattccaggtttctagaattggtatctagccagaatttgtcccagggctaagtggctaaggcagtgaactagtctgtcagcttctctgttttaaatggagtcatgtaattccattacataccctttgctttcaactatatggccaaacatgactggccagcaggctgggggacagaagacatgtgggcttgtgcttgttacctggaattgaaaagagctcttggcatggttcttgttcaagctccatggttgactagcacatgaccaccaagagagctactgtacttctccgagactcattttctcttctgtaaaaaatgactgagtttctttcacagtgcataaatcttttcctccaggaacagagactgcccagggcctgtccaagacaactaggaaaccagagcagcagttaagccattcctgggcaggaataaatgagcagatgtcagctctcagaatctcagttttctcactcataaaatggaaaagaatactatttcttttatgtcattcaccatattgtgagctgaaggcactttaacgatgctgaggctgtaaactaatgcataatgtgatgtttatcattcttcacctatgttttagttactgagcatctcctgacaccagagaggacgcaacaaaaatcacaactcctagaactgcacagtctaaatggcaaccactagcccctgtgacaactgatcacttgaaaagtgagtagtccaaattaagatgtgctgtaggtgcaaaatatatgctggatttggaagatgttctatgaaaaaagtatctcattagtcatttttatattgattacatattaaaaagattccattttggctatgctggactcttcagatatatcctgggagattgtattaaaagaaaatacatgatggaaattagtgtaggtagttactagaaaatgtaaaattacatgattcacatcctatgttcactgttctagacatataaatataactttgagttatttttaagcatgagaagacagaaatcgacgaataaagtgaaaaagctaaagattaaagatacttacaaatcattgttgtattttttaagaggtcattttgagcatattccttaccattgaagcccctgcctgtctggctcctctgcccaccttgttttgctaatgggtcatgctcctatatgtgcatagacgaggagcggctctcagggactgaccgtaagcatagtcagcacagcacgtatacccatgctctgaccccaggttggcgtcttggagggtgaagcattttcccagtccttctttgactcatcacagaggtataaaacagcgtctccaacacgtgatttttttttttttttttttttgagacagagtcttgctctgtcgcccaggctggagtacagtggcacgatcttggctcactgcaacctccaactcccaggttcaatcaattctcctacctcagcctcccaagtagctgaaattacaggcacacaccaccacgcctggctaatttttgtattttagtagatacggggtttcacaatgttggccaggctggtctcaaactcccgacctcaagtgatccacccatcttggcctcccaaagtgctgggattacaggctgagccactgtgccagttaaaagaaaaaaaatattcaaacatatttggtttcttattgaggtgaagttcacataacatgaaactaacagttttaaagtgaacaattcagtagcatttaattaacaatgttgtccaaccaacacctctgtctagttccaaacatttttgtcaccccaaaaggaaaccacgtgctcagaaggcagtcactccacatcacccctcttcctagtcctatgctttgcacacaactgactcaccctgacagttataacctaaaagttaaataaaattattagtaaactgcaaacccctggcaagtgaattacttaatatctcttaaaatcctgacatcaaatgattcccctgtgaggccatgagatgataagaacatccacctccctctcttgctccagtggaatgaaaccccctcctcaaggagggttacactcaggcataggcccgatcactcatcatatattgacagatgtgcaggcctgagaccccgccttctggagctttctaatgctccttgtttctcaatccaatccttgctaggaattaggctcttctgctgaatgtaaaatttttccatctgcctccataaagtatgtgccacctgtcagctgactggtcaaccccaagctcaaagtatatggacattttgggggtgacaatggtgggcatacatctttagcaaagattaagaaggtaccagaggaggaccagcacaacccagcaatgcagcagaatccatcaggaaagctttggctctgggtggagctccttgctttagctctgcctttgagcgcttgggtggctggggaggcactggggtggaagggaaggaagcaggaattcgtgtgctgcaaatttcactacacttgaccacaacttggagtggaaagggcactgtggtacgtctatctggccttcctttacaagccttaaaatgctgtggaatccatctggatggaagacgccatccaattataaatccttaggatactttttattgccctttaagagttccgatgcttgctcttccatgcccatatgtttctgcttaagaggcttcattcaaatcaaattggaagagaagtccagattacccaactacaattacctgagcaaaaatcccctcaattatcttggtaatccagataaattcggagtacaaaggtgagttgcctggatagcactggctaagaactgctttgtctcccatttcaccttgcattattataatctacttgattacacttcatttataacaatagggagggcttgttttatgccacacattgccacttgctcaagtgtaaaataaaccttaaatgactgatgtactgctaaatttatctcaaaaaacaatcataacaggaatcttaaggcaataaagtcaaacaaatagaattttacagaatttaaaaattattttgtgagtgatttatgctaaaatacctcaaatttatttcaaaaacagtcttacttaaaactgacttaaaatatatgtaggataaataatttgtagtgaatttaacgaaacttcagcaattcaaatgaatgcacattattcttcttaaaaacagatatcctgaaaatatccatcaggataaatagctaatgcatgtgtggcctaatatctaggtgatgggttgataggtgcagggaaccaccatggcacatgtttacctgtgtaacaaacctgcacatccggcacatatatcctggaacgtaaaattaaattaaatttttaaaaagcagatatttggaaagtaccaatagcttcaaagtaaaaatactctacactgtttttgtttgtttgtttattttcgtttttgtttttcttttttgagatggagtctcgctctgttgcccaggctggagtgcagtggcgtgttctcagcttaccacaacctctgcctcctgggttcaagtgattctcctgacttggccgtgccaccatgcccagctaatttttttacatttttggtagagatgatggggtttcactgtgttggccaggctggtctcgaactcctgacctcgtgatccacccgcctcagcctcccaaagtgctgggattacaggcgtgagtcaccgcgcctggcctatgcactgttaattttatcacgacagttataaatccatcaagatgtcctgtgatttttcaacacaaattactcaaattatgaacttctctgtgtgtattttccactggcttgtttatgaatcctgctgatatgtctgctacaatttctccaaaggctaaaagatgtttacaggacaaatgacatcatgaccatgtcaggcttaaatgtgtttatatcagttgggtttagagggtcttcaaaacatggctttaaaatctcagttattatggagcttaatgtgttcctgatgtttctggagtaatgtatttctaaaaatagagaaatagattggttaaaagaaaatgaattgttggtctaatctgtcttatgcatggctaacgaaatgcattttcactctcttccgtgataatacgacacttaaaactgtgaggaccaatggggtgataagagacaaaataaacagtaaatagatactccatgtgagttactactctgtaatagatagaaaagatattttatagaaaagggaaaatacccacagacatataagcaatgtcctgtggttgctatcaaatttactgttagctgtttaaaactgccttaaaggttttttaaatgtgtcttttctaccatagattctttagacgacagccatcaagcagcaaatacctcgcaggaggccattgtgtttctatttgaacttctatggatgtcaagctctgttcttcaaaatttagccctacagatgggtggcccaccggagagaattaatctcactatgcagccaacactaccctttctggatctttccccagtagtgtggattctgctctagtccagaattatgcagaataagtatacttcatcttagacaccataattcttcaaatatctaaaatgtatattatgctctccaaatcctggtcatctccaggttaagtatctctcaaaaacagtccatcagataatatgattttaaatctttatccccttggtcatatacccacaatctcattctatttaccaatatccctactgatgcataaactacatatgtatatgtgtgtttttttttaaaaaaaaagcaattccactgtaattttagcagaggttatttccacatagagctatgtatatgtgtatatacacatatctttatattatatagttttctgtgctttcccagttatctacaatgggcatatatgacttttatagccaggtaattcaatattcattcattcagtgaacatcattgagcatccactatgggctgggaagtgaggatggagccacaaacaagcaaaataaaaacccctgctcttgtggagttcccttctcattggaagagacgtacagtaaagaaaaaaataaaagagtaaagttaatagcctgtgagaaggggatataaaagtgggaaggaagacagggtgatgtgtgagaaacactttttttttttttttttcagatgaagtctcactctgttgcccaggctggagggcagtggctcgatctcagctcactgcaacctccacctcctggtttcaagcagttctcctgcctcagcctcccaagtagctgggacttcaggcatgcaccaccatgcctagctaatttttatatttttagtagagacaggatttcaccatgttggccaggctggtcgtctcaaacttctgacctcaagtgatctgcctgccttgacctccgaaagtgctgggactacagcaatgagctgccaagcccggcctggggaacactattgaatagtgtggtcagggaaggctttactgtgaaggtgatgaagacccaaagaaagtgaggaactaagtcataaatgatgggtagaacattccggattgcgggagcagcaagtgcaaaggccctggggtgaggaataccaagaatgtttgtgtgggcagagcagaaagaaccaagggtaaagcattaggagatgaggctgaagaagtaaccgggatcaggtggttagggccctcaggccctggaggaaggctggcagcgctggagccacatggactgacaatgtctagcagtcatcccggctccctgtgaagaacagaccctcgcttgcagagaagcgaggacaattaggaaagcagagtcatgatccacgcacaggatcacggtgacttggaccagaaagagagcagtggagctggggagtgactcttttcagtatttctcaggtggtaccagtgggatctgcagagaatacatagttaaaggaaatgtctggaactaaacatgactcttcaaacgtgatcctactgtggcagaagagaggcgactttacatttcctttcccaggatatcttattctaatgaacacagaaaccgtaaaatcaagccaaccaacatgatgaaaatgattatataaggtacacagcccaggctggatttgaactgatgagggaaaaaaaatctctagtgaaaattcctctctctaaccacagccttctctccttccatctctgcctcacccttgctctttctgaagccttcctggatgctcatgaagctctctccttctttgactcatcctattttcccaggacctttatcaactcagggctcttctcccctccccacagtcagctcactgtgctctgactagttccctgaaattgctcatcctcttactaaccaggaagcttctacccgctcttggtcttctttctccaccccagtgccaaagaactaagcactgatggagaaaaagcatgcggctaatactgtctgtctctaccacaaatctcataatttttaaaatccatttggaatttacattcactccttaacttcttttcattcactcctaattcacttcctatataattctctacacagctgctgaaaaccttcctttctgctgcctcttaccccaaaactactctcacattactcacaaaggttgaccttgttttctatatacttttttagagtaacgaagccataaaatgtaagttctttcaacctggacctcccactcttgggatttctcaatagcttcacctgtattctcccccttcactcttgactcagaggtaaacgctcccttgctcccaaatcctttagcaacgtagggttgataattgctcctttccaaatttaatccctgcatctgcgcccctgagacagacactgccatgatttcccagcttgctgtcttctccctcctgcatctcctccctttctctgtgacggatattttccctgtgcaagagaaatttcttctgccctaaaataaataatccaaaacatctcttgactccacttaagctaacattcaatatctcactttcccttgtattaacaaaagttaattgagtcagtacggtgctacaattctcagacacaacgataaacatgatagagaccatcaacatgccttggcattttgcctgctttctcttcaattacttgcaacttggcttctactgagctccactgaaaaagctttcatgacatgaccacatccaatcccaaagaaactgtccccttgcccagtggtcttcaaaaccctccaactccacagtgtctcattaactccaactcatttcctactaaacatctcttctcagctcttcaaagtcaaagattgcgaaccaaatctacagacttctcctctcttctcctttgggtccaactccatccttctccatgaaacttcttattcctagaaatggtgtctgcaccttttaggcttccaggcttgagcctagagtcatctttaactctttccatacccagactcccaagacccagtcagctgtttaggtgtctcctctgtatgcagcacttactgtcattgccctggtccatctcccagagcccacatcttgtcccactgtctgcaaagcctttcctatatgctggatataagtgcaaactccccctaaaatcccattgaagtttttacttttttctatcttctttttttacttctttttatcttcctctactcacacagaagtgctccaattatgaggaccttattttattccctttactgtcaaacacaaagccaacatgccatacgaaaagatagtactgtgcttccttcagtgccactctagcacgcccactccagcacacccttcttgtgcgggtgtatgctcatgtgatactatcacaggcaacacttactatgcaatacgttttccacaatcacaatatttccacaatattgtgatatgagctcattcttcaggccttgacacaagcgcccacaaacctaagagaatgcattttcatttttatgatacacagttttcgactgctccactctggctgccaaggcattcctcctccaaatcacgatgtctatatcaaaagaagaacaatgagggagagctggaggtagcgctaagaaacaacctggtccagctcccaggtctcatagagaacactcagaacacgcttgttagaggtatctgctcctggcctcagcttctcagaagcaattacacatcttctgggtaaacgtggagtgtgcagcacagaataccaaagctgagcttcccattgtacctggttgttgatctcctcgttgacctccctcagctgaatatttcttaagaacagtgttcaattaatccaactatccctggtggctggcaggatgaatcagttatgacttatttcatgtttgtgggtgggtgtatgaagtggtcctcaaaggagatttttgctctctgcagacagtctgcctgtctgtaggtcacttcctgccatttcctttgagtgggaatatgagccagggtgttggaagaaggaagagtccaaaagatgtctcagggaatgtcccatagccattggcctggtctgccctagataacttctgagccaggtcaccctaaagtgctacatgaaaagtcatggattttttttctaacttgttgatctcaaatgtcgtgatttggcatgaatatctagcttcccatgttgcagctatggatttattcttgccaaaatattggggattgggctggagagggaagaaggtacgaagatgcattctgtgttgctcaacaagatctgcatggcctcaaccaatgcgtgtttgaccatatggatatttacaaaccccaccatcaactcaccaaaatgaagagtgtcttagacttattctcacaagacaagagggaacgctgcctctaaggagtctctctgggacacctgggagagatttatttaatggtaaagcaaggaaaggaaaagatgaacagtgacctgcaaatcattaaagagggcgactcgatcataggcaagggcttttattagtgctaaaattccacttcaaagtttgctgattcatggatgctttttgttttgctgtttatgttgtagaaactgatttgattttcatagacaaaataactaggcatttataaccacatataggtatgaaagaaagataaaatgatgcccttagcccagtcagaaatactcttaaccatcaaaatagttccctgaatctaataggccaacaatattccaacaccagaacctttgctaccatagccagaatttttaagactgcaccactgttaagtagaggcaatttttaatacttagggtctaaccacaaggcataaaatgcaaaaaaaattacataatcctgtactttttaataattaaatgaaaatacatagactctaagcaggaaaatatctgagatccttaaaacggtataatcataattgttctacattggtaatatgtgtgatgatatttttctccaaaaaaaattctctaccatttcattctctttaatttcttctagcccgtaaggtctagcaaagaggaatacctgaaaagatgcaaattgtacccctgtgctgttcaatgacagcaaaaattgcagctccccaaccccacctcttatgtcccctgagcaatctgtgatcacttgagggtgaggacagtatattgccccaataaactggctttccaccaagtaccaccaagaaatcaaaacagcttttattttattgtgtcatcatatataagttaatagttcataattagttcaaaatttaaaattatgttctaaaaataaagctttctaagtcaatgtaggcaacgattccaagatccttatagttttcctctcttaaacagagaccattatcatatgatttttttttttttttgagacggaagctcactctgttgcccaggctggagtgcagtggtgcgatctctgctcactgcaagctctgcctcctgggttcacgccattctcctgcctcagcctcccaagtagctgggactagaggcacccgccaccacgcccggctaatttttttttttttttttttttttgcatttttagtaaagaccacgtttgaccgtgttagccaggatggtctcgatctcctgacctcatgatctgccagccttaacctcccaaagtgctgagattacaggcgtgagccaccgtgcctggccagtcatatgatttctaaagagaaactgaacagttatttgtagaaactctgcaaagcatgactttgggacgggcacagtggctcacgcctgtaatcccagcactttgggaggctgaggcgggcagatcacgaggtcgggagatcgagaccatcctggctaacatggtgaaaccccgcctctactaaaaaaatacaaaaaaattagccaggcatggtggtgggcgcctgtagtcccagctacttgggaggctgaggcaggagaatggcgtgaacccaggaggcggagcttgcagtgagccaagatcgcaccaccgcactccagcctgggcaacagagcaagactctgtctcaaaaaacaaaacaaaacaacaaaacaaaacaaaacaaaaaagccatgcccaagcccacccctgaccagtgaaatctccgggattggggcacaggtataatgtttttataaacatcttcctagatgtttcctgcatccagggtgataaatcatcatactaaaggcatcatctgaaggctcctagagtatagagaagttcagaataaggaccccaaactattgcacatcctgacactaactagctgtagctgtgcaccctggacagggagagatctaaacagctagttatcttacttcaccgaaatctacaactaaagatgtctatccacgtgttatagctttggcttccctaatctagatgttcaatctacttttctgcaatttggcaaagtaaaacacacatatacagtaatgcacaatgtcctgattgttggggtttattatttgttttgcatttacgcttcttaggtatgtaacatgccaaagtcatgggagctgagtcttttgaaacagaggcttctttgggtgcaaatattaattttctatgaaaaaaagagaaagtacaaagaaaagaaaaaacagcagtaatacagaaatgaatatcttccttgtctaggacacagtgttttttttaacctagatttctttgaacacagactgacacaaaaattaaatactattgctccattggagaggtgcaaacctggggcggtgagagtgaggggaagcgagtgagattgtcactacactagcttctggggacatggagacagccagtcactgagcccctgccttcccttggccatgcagatgcctctgataggttacacggaaaaattctacctcacagcagcccatggggtggaggaaaaataggaacttagttgcctacattcttcctgcatccccttcctcattggtcagagtcaccctgcatgtctgggttgtcacctgctcccaaggtgaccactccaaaagtcaggttctacgcccggtggtggggtgcttcatccaagtacagaaatgccaagaggatccggaaaccttttgacctggttgctgagtcacaggaaagaagggccagccctcctgggacaggtaacaggctggccctgagctgtggaagccctcacacccagaaggagtcaatctgctggggtggccactgagaccaagcaggagctgagggtcctggagtaatagatggaggcccatgagatgtgttcagacacatagtgtgtttgtcaactgcaatgtgtgtgtgcccccaaaattcatgggtttaaatccttacccccaaggtagcagtatgaggaggaggggcctttggaaggtgactaggtcataaggatggaggtctcatgaattgcattagtacctttacaaaagggaccccagggagattccctcacccttttgtcacagtgtgaagacccagcaagaagatggacatctatgaatcaggaagagagccctcaccagaacccaaccctgctacactctgatctcagacttccagcctttagaactgtgagaaataagtttctgttgtttatatgccactcaatgtatagcactttgttacagcagcccaagctaagacagcctattatgtatgagcaggtggctttgagataattgagaaaacagagactataactacaaccagccagagatgggatcattgcaaatgggactcgggttcacacaaggtttgtgacacacacacaaaaaaacataaggcagataaatcagcaagggtagcagtcaggaattgacagacgattaatggattgaggaaacagaatagataatttaaaagcaaacctttgtacacaaaagaattcaggaggtgataaaagtaacattttcatatcagttggaaagtaagttattcaatagcaacagaacaatcatttattgaggaaaaataactatttctttcctggttcaatcttggggtgttgtatgtttccataaatttatccctttttttctgggttttctaatttttgtgcacagaaatgttttttaatagtctctgaggttttttttttatttctgtgggttcagtggtaatgtcccctttgtcatttctgattatgcttatttggatcttctctcttttttctttatcagtctagctagttgtctatcaatcttatttattctttcaaaaaaccaacttttatttttgttggtcttttgcatggtttttttgtatctcaatttcattcagttcagccccgattttggttatttcttttcttctgctagcagtaagtttggtttgctcttgttttttctagttcctccaggtgtgacattaggctgttaatttaagatctttccaactttttgatatcagtgtttagtgctataaactttcctgttaacattgctttaactgtatcccagagattctggtatggtgtatctttgttttcatttgtttcaaataatttattgatttctgtcttagtttcattgtttacccaaaagtcattcaggagcaggttgttcaatttccatgattttgagagatattcttagcattgattttatttttaccgtgctgtggtctgaaagtacggctagtatgatttcagggttttttttcatttgttgcaaattgttttatagccaagtgcgtagtcaattttgaagtatgtgccacgtgtaggtgaaaagaatgcatattgtgtcgttgttgggtgcagtgttctggagatgtctgttaggtccatttggtcaagtgtcaagtttaggtctcaaatatgttaagttagttttctgccttgatgatctatctaatactgtcagtgagatgttgaaatctcccactattattgtatggttatctaagtctctcactaggtccctaaaacttgatttatgaatctgagtgctccagcattgggtgcatacatatctagaacagttaagtcttcttgttgaattggaccctttatcattatataatgcccttctttgtcttttttgatcattgttggtttaaagtctgaaattgaaacgctgaacagaccaataacgaattacaaaattaaatcagtaatataaagactaccaaccagaaaaagccctagaccagagagattcacaaccaaattctaccagatgtataacaaagagctactaccaatcctactgaaactattacaaaagatttaggaggaaagactcctccttaacctcattttatgaggccagtatcattttgatacagaaacctggcagagacacaataagaaaagaaacttcaggccaatattcatgatgaacagggatttggaaatcctcaacaaaataccagtaaaccaaatccagtaccacatcaaaaagctaatccaccatgattaactacacattattcctgggatgcaaggttggctcaacatatgcagatcaataaatgtgattcatcccataaacagaactaaacacaaaaaccacatgatcatctcaatagctgcagaaaagacttccaataaaattcaacatcctttcatgtttaaaacactgacaaactaggcattgaaagaacatacctcaaaatactaacagccatctatgacaaacccacagcaacactgtactgaacaggaaaagctggaagcattccccatgagaattgaaacaagctaaggatgcccactctcaccactcttagtcaatatagtactggaagtcctagccagagcaatcaagcaagagaaaaaaaaaaaaaagaaacaaaatacatccaaatgggaagagaggaagtcaaactatctctcttcacagaggacgtgatttatgtctggaaaacctcattgtatctgtctaaaaactcctggatctgaaaaacaatttcacaacgttttaggatacaaaatcaatgtacaaaaatcagtagcatttctaaacatcaacaatgtccaagctgagagccatatcaagaatgcaattccattcaaaatagcaacaaaaaaaatacaatacttaagggtacagataactggggagtgaaaatctctatgacaagtattacaaaacaaagatcaaagaaatcagagatgacacaaagaaatggaaaaacattccatgcccatggataggaagaatcaatattgttaaaatggccatacttcccaaagcaacttatagattcaatgctatttctatcatattactaattacattttcacagaattagaaaaaactatttggaaattcatatggaaccacagaagagcctaaatagccaaagcaattctaggaaaccaaaaagctgaagtatcacactacctagcttcaaactatgccataaggccacagtaaccaagacagcatagaactagtacaaaaacagacacataaaccaatggactagattagagaacccagaagtaatgtcacacatctatagtcatctaatcttcaacaaagtagacaaaacaagcaatgtggaaaggattccctattcaataaatagtgcttggataactagctagccatatgcagaagattgaaactagactctttcattttaccatatacaaaaatcaactcaagatggattaaagacttaaatgtaaatcatacaactataaaaacctagaagaaaacctagaacataccattctggacataggccctggcaaagatttcatgacagactccaaaagcaatggcaacaaaaacagaaattgacaaatgggacctaattaaactaaagagcttctgcacagcaaaagaaactatcaatagagtatacagacaatgtacagaataggagaaaatatttgcaaattatgcatccaacaaaggtctaatatgcagaatctataaaaaaaaacttaagcaaattaacaagcaaaaaacaacttctttaaaaaaaatgggccaaaaaaacatgaaaagacacttctcaaaagaagacatgtgtgaccaacaagcatatgaaaaaacgctcaacatcactaatcactagagaaaagcaaaccaaaaccaccatgagatatcatgacacaccagtcagaacggcaattttaaaagtcaaaaaataacacatgttggtgaggctgcagagaaaaaggaacagttatatgctgcgtgtgtgaatgtaaattagttcagacactgtggaaagcagtttggagatttcccaaagaacttaaaatagaactaccattcaacccaataatcccatcactgggtatataaaggaatataaattgttctactgtaaagacacctgcattattcacagcattattcacaatagcaaagacatagaaccaatctagaagtccatcagtggtggactggataaagaaaaaaatgtggtacacaaacattacagaatactacacagccataaaatagaatgaaatcatgtcctttgcagtaacatgaatggagctggaggccattatcctaagggagttaacacaggagcggaaaaccaaataccacatgttttcacttataagtgggagctaaacactgagcacacatggacacaaagaatggaatgatagacaccaggggctgcttgagggtggagggtagacgaagggtgaagattgaaaaactaccaattgggcactatgcttattacatggtttatgaaataatctgcacaccaaactctcatggcatgcaatttacccacgtaacaaacgtacacgtgtacccccgaacctaaaataaaagttagaaaggaaaaaaaaaaaactaaatccctatctcacattatacatctaaaaaatccaaatagattagatttaattaaaaattaaaccataaaacacagaaagaaaatacagatgaatagttatataatttaggatgagaacagcctctgtcaggatgaactaaagaattcacaaaaaaaaatgttaacaaattaaatgacatgttaaaaatctggccaggggtagtggttcacacctgtaatcccagcactttgggatgctgaggcgggcggattacctgaggtcaggagtttgagaccagcctggccaacatagtgaaacctcgtctctactgaaagtacaaaaattatccaggcatggtggcacacgcctgtaatcccagctactcaggaggctgaggcaggagaattgcttgagcccgggagacggaggctgcagtgagctgagatcatgccactgcactccagcctggctgacagagggagactctgtctcaaaaaaaaaaaattaagaaactatatattgaaagactataaaaaatagttttggtttttttctcagtaaaaaaataatatatccattgtcaaaaattttctattttcaatattattatttaatagaaaaatttcaacaatttctggagaaaatatatgaaacacatttgacagagttttaacatccttaacataaaggatgtaacttatatgttacatccttaacataattttctttgttcagttaacaagtttttattgagtatctatattgaaatatgcactatgtctgacactggcaacacatttgaggaaataaagaagaaaaattcaagtccacatggaaaaatggactaaggacatgaaaaagtataaatcatcagtacacttctaataaagttaataatcaaagaaatgcaaataaatgtgacctatcaaggtcttgctatttgtactgtcaaattataaaaatacaataacaaatattggcagatattggggaaacaagtaatgtcatatactggtatgtgcttaaactggtaaaagtcttcagaaaggaaattggaaatatatgtaaaaattttggacagttgcatattctttgttctagaaattctacttatatgattagaacctaaggaagttatcatagatttaatcaaagatagttacaggatattcaacatagccctgtatataacagccaagaatctgaagccaacaaaaaatatttagcttaaaatgtatagaatatacataggatgaaattgcataggtcactaaacagtttctagggacatggaaaaaaaaatgccatattgcagaaatgcaatattttgggatgataaaagggcagtttcaaaaaattgaaaaaatagcagttactatgacctcttttggcaaaaataattatatgtaatattgttcatggaaaaatagactggaaatataacgattaaaatgttaattgtatctgggttggtgagattacatataattattatatataatctttacttttttagattgttgttcacagtgacatcaagatttgtcatgggagaaaaaatgaagaagattattattttgtagtcacccaaggagagaagaagtcacatctctggagataggaggagatagggcatatgagccaatcacatttctgcagccttttgtggatacaaaaggggtgggccaagcctttccaatatcccttttcctccttggtacccagacagactatatttaccagcctcctttgcagccaggtgtggtcatgtgactcattcctggtcaatgaaaggtagatggaagcctggcctaggaaacaggtctacatgcaatcttccattcttctcccacccactggctgaaaagaaaggcttctgaggacacagagtggggggaaggctaggtagaggctggatgggaagaaagcagggttctcttgctcctctcatcagagagctactgaggagacccaccgcacccagacccccatactggactgttacaggagtgagaaataaactttgtttagaccactgaaatttgagagttagagctattagcctaccctgattaacgctggggtagcccctcacatctgcccagcaccctcagcagagcctaacccaatcatccaaggttacccaatagagaactcaggcttccactagagtagccgtcacatagagttactgggtcttccaggttctgccacctccaccgtgttttgtgggactctccactgaactcacaaagcacatgtattcagctactccaaagctatgtgtactcaggaagagaaagttctaaatgtttctgtgaccttgtgccactgatatcatgggttctatccttcagagtgctaagaaaagtgttaaatctccagaatagctttggaaaagtggagaaatttgagactttctctatttttagttgctaatatgcattcctgaaaagtttatttaaagccacaaggaaatatttccatattgaatttcaatattgcaatatactattttagaataaaatggaaagatccaggacatagagcagctgagaagctacacagttggcccctgggcttcactcagacagtgcttctctaggctgcaagtcataagtctttgtgtcacccacttttagaagacatcccccggacttctgggaccaacctgaggtttgtaggaatctctgaggatcaatgatcaaacatatattagcttgaaaaaaaactaatatatgtgtatgtttttttaaaaggttaagtttttaacaatttagacgtcttggcattatactctgagaacgttaaccaatgagaataagagtgacaatttagatgtaaaacctcttaaaggtaaagataaaatcctaaccacatggggaaaaccatgtgttctgtggatgatttccctggatttctcaaaagactcttagaatgttctgggtatgactttgggggcatctgttctatgaagatgggcaccccagcatcacctgcatattaacccttcttcttgctcctaaagatgcagaattagctgagattaggaagatgtacaaagtgttctccctgcacttcaactaatgaacaaaactttttaaaaattacttatgatttggaactattttatcattttatatatcctatggcaactggcattttatatttaattttatcatcttttgctttttttctttgatctaaatcaggatgctaagttttgggggggggtcctacagttttggcagagacctcattctaaaaaagaggtaccagactattaaggcagaatctgctgagggtggccccaaacctggtctggtgaacctcactcaactcatcattgatttcaagggcacagaagaggcaaggagatgacagcaggagaaatggacatgtaccatggagaaaggggaccaaccacaccttctgtccaaactgagatttcccagcctgaaacaggtcaacactggggttagcaagaaactttaaactgaataggagattaaagtaataagaagatgagtactattattggtacaaattatattggtaatagttttaagtttcattctttaagacagggtgaatcacagtcccttctctcaaggtccttgtcagcattctacttttccaaggacattcaaaaatttctcatccaaagtcaaacattagtgtgtgtgcctcaaacaagaaatagttttccatcagtctccaaatctttgaatagtaaatggcaaaagtatggaaatgcaagatggagtggggcttaatgttgccacaacattcctacaatactgggatagtcttccttgggaattactttctttcctatcacgtatcaataaggaaagccaaatgtagaaataaagaaatctccccgatttacttaacacacggaggtgacagttacagcgcaaattgagggaagagtaaatgatttccacaaatgaaccaaaaacacttaaaagccacatttaagagaaatggagtcataaaggcaatatttgtgagcagataaaaaatcagcacagaaaaaggtgagaaatacacaatgtctttcatcaaggtgcaaggaaatgtaaaataacattaaaagtaccaactacataatttgaatataaagagaacaatagcaagaaaggagaggggaagtgatggcgatatggagacacagtctcttttgcatgcacagggcagaaccggtgcctcaggctggagggtgtctgtgagtaccccacaatgaaagcaaaagagcacccagcattgaagccacagaccttgctccatgaatcctagctgatgggctggcacagagagatcaggagcagaacaaggaaatccataggaggatcctcccaaagtacttttttttctggtccaaaaatccttaaatctgtcagaagcaggaggttggagtgggagaattgcagagcctggaacacacctgcctgctgatgacccattctgagggggttctttccacttggcagcaatggacttggtaaaaaaaataatagatccttctccatggatcccatttccctttttttttttttttttttttttgagatggagccccaggcagaattaaagaccaactctgggacccaaatttttagaggacaaaggttgatataatggccagcacgatttagtcatttagatttcaggtctaactaactgatgacagactttaacaaaatcactgaaagaaatttaacgtcaaccttaaataacagtagaggcaggtaatataacaaatagagtcaaaatggtttatctaaaggtctaagcccaagaaacatccaacaataaaattaatctaaaacaaattttttaataatcatttttttttcttgagacagagtttcgctcttgttgcccaggctggagtgccatggcacggtcttggctcactgcaccccctgcctcccgggttcaagtgatttcctgcctcagtctcccaagtagctgggattacaggcatgcgccaccacgcccagctaatttttttgtatttttagtagagatggggtttcaccatgttggtcaggctggcctcgaactcctgacctcaggtgatccacccaccttggtctcccaaagtgctgggattataggcgtgagacaccacacccggcctcatcttttctttaacattacaatttcccatcatggtggcacttgacagtagtgggactgtccaacagcaaatgaccccatctaagcactcaggacagaagccattttaggtcatgaaaattatacagattttgtgagtgaagggcatttagttctgagcagaaagtagtcttgcaaaagggaaatttgcaacaacaacaaaaaaggacaaggagggtgacaatgtcaagcaaatgataaccctgctggagcttcagaaggaaccagctacatccctttcctgcttctacagatgctatggcagccccagaggtgtcccactaggatctcccttcaagaaagaatctagcatgcatctgaacaacctccagctgttcacacctcaggccctgcctcatcccagacagccctgagccaatcactgacacagcagggtactagagcctggtcatttctgcccaacccggggcccctccaaaggcaagctctgctccagacctccccgttgggttggtcaaactatcaaatctgtacctggtctgaggctctccctgcccagtcttgcttcatcctcattttatccttcacaggcacagcccccttccccctccaataaaacactaacattcctaattccgtctcaacatctgcttcccagggaacctaactaacacaatactcctaaaaccaataccagcaaaaagtgactttccaagcccctacatgaagactcattttctggaaaataaaatttaatataattccaattacccatgacgctatttagccatttcaaaggaaatgagaaagcttcccaaattgtggtcctcatggagtgaactgatcatcaaatgttgctgtttacatgagggcacacaataattagggttgtatgtaacatgctactttcagattttcaggtaagtctaaatgcttttaattgatgcaagaataataagtccttcagttgatttatgtcatgcattaatatcaatcaaaaggttttctaacacatactttttaatactataaaatgtggggttttttttaatgtcttttttttcttattcagagccacatttcttcacatggtatgttttacctaacctaagggttatgttgttcgtttgtttttaatttcaggtttgaggaatcaagtaacaggtctttctaaatccttttattggatatatgttagttttccattatcataaaagactgaggaacaggaacagcagcatattgtttaaatgattcacaggtaaaaatatcttctccctcttggtctgttttctttcctgatgtctttgctcattgccaacattgtctattttatatataattcttgcaggacattgtgccctgaaggtgaaattggacaggtaaggagatgacccaacaccccttgtcacacctgcaggctctaggtcacttttgtaacacacaatgaaatgggtaaattctacacaatcctttttttttttttttcaaacaataacagaaagtaaatatttgaactgggggctttttcaaacaacacaagtcagaaaaaattgacttgtttttgactgttactttaggcatatatttttgattaatgacaattaaatgtaaatataaagatattttaaacttgaggttttaaaacaaagaatgcaagaatcacctggttaaagttagatattttgtcagtctcaaagtcagttggctggataataccatatcataaaattttataagactaatttgaaggtccatatgaattggtattattgttcgtttttcaatattgatcttagcagtgtatttacagcatacagcagagttaatgtttaatacaaacaaacaagactttccagaaaatctacaaagaatcactaactaatagccatgcttcagttaaatttgtttactttttaaagtacattctcagaagtaacatgtactctcaattaagtaaaacacaaccagaattttggaatttgatctttaaaataataaaaaaactttctctgctatttacagccttggttaaaatcccaacatctggataccagaatctgagcagcaaaatccacggagacacatgtgcaattttatgcctgcaagctcactattatttagaacgaaaccaacgtagtgcatctacccttgtttcttgctacacagaatgtatccagagtacaaactaatgtagattattataaaactcagtgtgtagatattatatatatatacacatgcatacatacacgcacatatataactaaaacaaaatcttcaaaaataatactttttctttctgtatgtgatgtgccctgatagtttccactttactccatcccatttccttttgttaatactggccttgactcacttagacaaatgggtcatgacctgtagtttggaaaacagggctttccagcctggctttaaagaggctggtcctcaggccagcagaaccagcagcacctgggggtagtttgtggcgcacaatctcaaggcctgccctagacctactgaactaggatctgctcttagcaaggtccccaggtgacttatggatgtattaaagtttgagaagccgtcctcctgcatgcaaaagtacagaatgagtatctgtgatctgaactacatttaaatcgataatgcacctcttaaactgtctttgttcaaagaacttctatcctactgagctcaaggagcaacacagtttctagcaagataggtgcaaagaaaaattcactttcaatttcatcaactgcttcaagaggttgcagggactggctgacctggtatcccagctcctgcaggaccgagagtgtgggaggtgggttgaggggaggtactgaattgactgcaatagatccatgagcatataaaagtgtgcgtgtttgttcttattcctgggagaaaatatatagtattcacctaattttaaaagagttttatggtttaaaaagttaagaagagctactaagccatgaaaagacgaggaggaagcttaaatgcacattactataccagataagaaaatctgaaaaggctacatagtgtatgattccaaccatatgacagtctggaaatggcaaaactatggagatgtaaaaagatcagtggttgtcagggcctaggaggtcgggagggatgaacagacacagctcagtgaatttgaggggcagtgaaactaatctgtatgatattataatggtggatccgtgtcatcacctgtttgtccaaacccacagaacatataacaccaagggtatacggtgtttatattaaagtataaccctaatgagaactctggactttgggtgataatgatgtgttgatgtaggttcagcccttgttacacgtcagccacccatgtgggaaaatgttgatagtggtggaagctatgtatgtataggggcaggaattatatgagaacacttgtggtatatgctcaagtctgttgtgaacctaaaactgctctaaaaaataaagtctgtaggtatctatgaaagcgcagacacatggtccgtgagagcacgtcctctctgctataaattggttgtatggttacaatcatacctagaaaggagagaaaataaagagtaagtgaataccgacatgttcaattctgccccagaatacaacaaagtccctgaatcactcttgtttcattgttgccattgcttattcaattcagtcaactcgtatatgtgaagcatgtgctacatacataacgtataatgcaggatgcaaaaatgattatgtgatcacttcaagtaatttataatctagcaaacatataaaacaggcacacagataatccttacatagtaaatgcctcctttttccccaaaatggcaaggagacaaatagcaaggatccgaggacagagaggcaaaattcagaaggccagaaaggcatggagccagaaatccaattcactcgcgagtaaggtatcgggagagagtggtgtacaacgtgacagggacacctgttgctcccaattgtaatcttttctgattggtttatgcccctttccaattactgtgtccatgctaattatcaactatttttattatcaaccctgcagaggggactaagagaaaaaaaaaaactgctgcaaagtgatgctgtgttcattttgcacagaacccagaaatcctgatgaaggaaactgaattggatgccacaagccttatctcctgtgaatgctgaatgactttgtcggtgggttttacgataagatgtactttcttttatatctattaaacaagctatacagaatactggtaaatacacagaagtaaaaagaagaataaaatagataaaattttctaagttaaaagctaagggaaaaataaaaagaattatcaattgatgtgatcaaagaaaaatgtttatctcatggggtgttggaaaaggaacatcataaaaattaataggtagaataatcatcaaaaacaatctgcacaacaaatattacatagctgaggggaactatcattaaaatataatgtatacaaattgctgagaaactcactacaccttctaaatcatgtcaaaagagttgtttgcatataagctgtctgcacttcttctctctctctctttttttttgttcatattcactgcaaggtggcttttgtccacccatgcaaatcactcatatgaaggtcacaatgatgtccaggtggccaaagcctgtggctaatcctcagtcctcatctcaccgagacagcagtttcttagcccttctcctacctccactggcttctcttctcagctcctctgtagttccccctcctctttccaacctgtatgcattggaggggcccaaagctcaaccctaatgctcttctgcatcttggtccctaggtgatctcacctagtcacccagcctcagatagccttaggcttaggaatcacaaatatatctctcacatgacctctagactcatatcaacctctcaacatcacaatttggatatccaacaggcatctccaactcaacacagccaaaccccacttttgacttcctgctcattgcaactgtcccctcttgcagatgtcccttttagagtaggtggcaccatcatatacccagttacaaacaaaatctttaaagtcatccttgactctcctacactgcatatctaatccatcagcaaatgctgtcttttccaccttcaaagtagatccccagtctgatcatttctcactacctcccctttcgctgcctggtgcctggcaatggcctcctaattggtcttccctgtttcaactcttggtccccctctagactgttccccacacaacagccaacatggttcttttagaacttcaaccaatgtaaattatacttcaagaaagctttaaaaaattcaatcagatcacatctgctatgaaccttccaatggttctcctcccgcagtgtgccaaataaaatggaaatgcccttatccttgcttaacagaagtctacaacacagcctcaccagcatgcctccaactcacatcctgcagctttaacctcactccacgccagcccccagtctccttgccgttacttgaaagtgccaggagagctcctgccaaagggcctttgcacatgctgttccctctctctgcaatactcttccccgtgtgatcatacggctcatgctcccactcccttcgggtctcagcttgaatgtcacctcctccctatgaccttccctaacctttcgtgtaaaattctacctctcccttcctcagtctcttgcttctcctgctttgttctggagaataccaaccagcaccacctgatttgtaactattcccttgagcacattctatctcagccacgggaatggaagcttcatgcaggcggggacatcatctgttcagttcatgctgtagcccagcaattctgaatgattagattgaaattggatccaaaaatatcacaaatgagataacgtaacttgttgataagtgtgtgaagagtatgaagagatgatcaagctcacaagtttccaagtgctaacatctataaaactccattgtcacccatcaaatcagcaaagattaaaaaccacaatagaatgtgataaaatagtgctctcagatacttcctggagaagtatagatgggcagaattgggtgatctggtatcaatgatcattctttcataccaatacaccatgggattttgcgatcagaaggtaaagaagacacagaaggaaaagaaggtgaagattaaaccagcaaaaacccataataagtaggacttcttcctattcattagtaagaaagagttgggtgtccccatgggaaaatgctaatttagtgtcctgaaccactgtaccctccaattcctgcttcccccacaacagtggccccacactgagtcctacaacgaggataatgatcctcaacccccaattgcacagacagggctaagtcagagacagtgatgccaaccttgctgatgtctctaaaacactcaactactgggggctaaccctaagcaaaattattgactccgattcctaagttaatttcctataaggtggaagaagcaacaagtgtcacttctcttctgggctctatgacaccaaatagtggagccgaagagacttgctgatgttttgaaacccaaggccaaataatgctctctaaacccttagaggtgtgactaggatattcacagaagccacgcaaaagacagcagccttcaatgaagaaacaaagaaacaaaaaacatggttccttttataaatatttatcgattatctaaggctaggttaattgttgataactatcaattatctgagcaagatacgcagaaacacttcaggtgcttgaactgcagcatcctgggctccaacccaaacttactggagaagaagctttagataccaggaatctgcattttaaccaactcctcagggaaactgccccagagggggtctaggctaaccatgcgcaacttccacccattctcctgggaagtgattgtgaatctcctccaaacccctcttacacttcctgattaagttggtgccccctactgaatgtcagcctcactgaatcttaacgaggaatcgccagactgggggggggattgtgcagcatgtctggggaacacttcactacttcactaaaccctgctgcacacatgctgaacaccgttccaaaggctacaggaactgagcaccgcattggaatctggccctggagggtgcccagcatggcgaccctgaggggtgcaggaacccagtgagaaggagaaacagaaggtacagtccagctcgagaccacgcacataaagaaatctgtaggcagggtctctattattgtgccatattaaatatcttgatattttaaagcaatattatttttctgattataaaagtactcattgtagaaattttaattgtgccatcatcctgcagaaaaatgaaagtacaaaaaacgaaaaagcagctatacacggccacaaagtcacagggctcatcgggatgtgctaaccaggctggaaactgatcaaagctgatttattgagaaaaaataggcagcatatcaaagacttacatcagcttcatagtagacagactttgggggcgggggaactctgtctcttttgagtatattctcaaaaggataaactttcaccttcctgtgaagcacagttactataaatcagatttgcaaactgtgagaaatgcttacaactcaatgagtcttttgtcagccagtgggggctccatcgtgaaatccacccttcgccatagcgatgggataaatcatcaccagccccgagacatcgcctaatcccttcctcgcaaggcagattcgggcgctttctgcatctgcttcgtgttattgaaaagagctcggctcatctgctgggctctcaggcttcacagtgacctcgcacagaacgctgctacttctgaaactgttttagactcttccgtctatgaaacagacacagagtttaagtttagcgtcttttatggtcagaaatatttagcgttacttccagagcggcagccgtggaacaatgtgggaaagaagtgcttcagttcacttcttgggaagtactgaccctgggtcaatttaattttttccgtaagatttccccttcttacttttctccttccactgctatatgtaacagtatctccccttccactgctatatgtaacagtatctccccttccactgctatatgcaccagtatgctagtatacaacattatagattaataatatgctatattgtttaaaaatattaatgttatataattaacatggtgtgcatattattatattgacaatacgtaatgtgatgtgataataagtctcactgagtgccaggcaccgctttgaatgctctaaactcattagctaatttattcctcgtgattctatggggtagatgcactatttcattcccattttacagctgaggaaactgaggcagctagtaacaggtggagccaagcttcacactgagatcatctggccccagcacactcataaaaatgagcaaaagtataaaagccaaagggaaaaggaagccaaggggtgaaaatcctaattacaaacaaatcctgggtaagctgggtttttagtccttccccacatgtgaacagcaactagaaacctgaacagtgactttgtttcccctgtcatccattgttggtgcctgatcctcacacaaaatcttacggagcagtatctagtgattagcttagctgaattgagcctggacacccttcatgagctggaggacagaggacgtgtcgatggagggtccaacttcaggcatctgtactcgcctgctacaggtgagtggacctatgaacccccagcctcatcaagcacccgagggtcacctgcctgcttcacctggaagagacagcaaggtgtgatcccaggaagatcctctgccaggaggcttacaggcagaagcagcggctgctgaacatagatgctgtcggcaggacacaggggtgatagggggtgagccagtggagcaggtgaaggtgcagactacaggcagcccccctgagatcctgcccagaccccagcagcagctcccctgtccctctctagcagcttcgctgtgcccgaagtgtttgagaacaggtgacccatgccctgagtggcagatgctgtgtctttttgatcccttctctccctccccccccacccccagtggggtacatggaaggtttgctaaatgtttgttgaatgaataaacgagcccaagtcagaagcagtctccaaatcattcctcatcgcaaaagggtgcggtggaaaaactcacaaagccaaggcaggaggacacactcaacttggaaacggcccgtgcccagctttggaacaggcacagcctgagcttcaaggaagtcacttgaccagcagtagctcccacctttccttgcagctagaacagcatcagaccaagtgatctctaatgtgatgatttgctaaagtacaatgagttttacaactagaaagtaccttcctctcaagactgacttcactatgagccacctaatttttcctctctcttcttttggtatttttgttgcaaatagtacacacaaaacaggatatataatctatttgtgcaatttaaagaataagaagcaaacacctttgcaggtactccctagtccacaacagtcagccccaggacctcagaagccccttatgcctttcccctaaaactctcccctccctgacaaggtaattccaatgctgagttatgtggttttttttccttatttttcttttcaacacatattacgtttctctgaataatatgctttttaatgttgcctctttttaatctttatttgtggaatcatattgtatgtaatctgtgacttttttctactcacatatgagaaccatccacactgatacatggctacagatagacacttggagtttatttttcactgctgtatagtactccattggtggagtacaataggtttatgtatccacttttctgtagatggacacttgggttgttctgtttttgctcatacatacctcctggtgctcaggtacaagggaatacagacccagggtgagactgctggatcacaggctaggcacatcttcagctttactaggtaacaccaagccaatacaaaagtgcttgtacaaactcatgctcctgccagcatggaggacccactgtgccacataaaaacatcactgttattaacttgttttatttgcatatgattattttttcccttatccccaaccacttctcaaagcaactagccagcatgtgccacacaggcaagcacccactccaatgtgatctatatggttaggtatgtatgtaccctggaaaaccctgtgatgttgcttgaggagtatataacttttttatgtatgtaagtagcatgtgctacaaagcgcgttctgttttctgtatttttcactccactcagtgttttgtaaaacatgctcatgttgctccataggtatcagagacaggatgatgttttatctttaagatgggtacgccaccctcattttatagatcacagtgatagctcacaattgtttagtactcagtggggtctaaatgtactaactcgtttaatctcccacgaaccctgcaaaacagatgcttccgtttcatataaaatgagaccaaggcacaaagaaactaaggaacttgtacaaaatcaccaagttagtaaacatcagagcaggatttgaattgagccagaatgtgttcttatccacgacatgaaactggataagaatgcaaagctcagagaattttcatgactagcatctctgggattcacagctggcgaccacggagcagaactaatatacagatggttcccctctcagtccagtcctcattccatcggctccaaaatgtgtattattctatatgattagctggtgaacaacaaaggcaattagttagtcctcttcagcaaatgttagtaaatgaaaatattatagagacagaactctttttaggaaatgcaatcatgtgaatttaaaaatgctttatcagaaatagaattaatgacaaaaatatttataggatcctaagaaaatggatttgctattttttttgtcggctgatgataatcatctgggtgcatctttggttgtgacagctccaccccttcagagagttgtatcttcatacacacctaacatgctaagagtagatgtgcatgatatggtagttagtataatttctgtaataaaaaaagtacttggtcatgcctgtaatcccagcattttgggaggctgaggtgggaggattgcttgagcccagagtttgagaccagcctgggcaagatagtgagaccttgtctctacaaaaaaaataaaaattagctgggtgtagcggtgcacacctgtagtcccagctactcaggaggttgaggcaggaagatcgcttgagcctgggaggcagaggctgcagtgagccataatcataccactgcactccagcctgggcaacagagcaagactatgtcttaaaaaaaataaataaaaataaataataaataaaaaatttttaaaaaaggtacctggaacggcctgcaaagaaagggaaatcaaattatgcttcaagacagtcactattatcactgacagagaagcagctaaaataaacagcctgctcattttgtttgtaaatgaattgccacaattcttgcactatttaaatcaagaatattttatattccatagttttcaaccacccctcctttttttattgtttccagctccttaaacatataaaaggataaaagccatttgttctggcagaaaagagtcatcataaattttgcagagtgaatttctctaagatgaaaggaatgttcctctcctccaggacagcctacggacaggactgtgatgacacagagtcttcacgggaatcacacctgcagtgttaagccacttctgtggaaaactcaagtccttctcagataacaaaaacattttagtagcaatgaaccaaaaacaaaatcttccactatatatgttaatacatcaaaaggaaccattcatgtgccatttataagaacttccttccggccaggtgcggtggctcacgcctgtaatcccagcactttgggaggccaaggcaggtggatcacgaggtcaggagattgagaccatcctggctaacacggtgaaaccccgtctctactaaaaaaaaaaaaaaaaatgcaaaaaattagccaggcgtggtggcaggtgcctgtagtcccagctactcaggaggctgaggcaggagaatggcgggaacccaggaggcagaggttgcagcaagccaagatcgcgccactgcactccagcctgggcaacaaagcgagactccatcaaaaaaaaaaaaaaaaaaaaagaacttccttcccagaaatcatagcagcgttcctcagcccaaagccagaagaaacttctcgcacatgaaattttacttcaaaaactcccatatcaggcattttaatgaatcagtggaagaaaattatcctcccaactttgttgtcaagaaccccaatttcatatgcagaaaaaagaattacaaaaataattattcgaattctaattggtgggattttgataggtttataaaggaaataaatatctttaacacaattctacctcgcagccaacatcagctattagcaaccacacttcttattgccagttcatctctccaaacacacagaagccatgtgagttgaaatttattttttaaaaactctcagttatgatttctcaaaattatatttcatatattgacatcaaccaatatgatgatgatattatatattgacattaaccaatacgatcaaccaatatgatgataattgtagggaaaagaaagagagatctgactgttactgtgtctatgtagaaaggaaagacataagagactccattttgaaaaagacctgtactttaaacaattgctttgctgagatgttgttaatttgtagctttgccccaaccactttgccctagccactttgacccaacctggagctcacaaaaacatgtgttgtataaaatcaatgtgtaagggatctagggctgtgcaggacgtgccttgttaacatgtttacaagcagtatacttggtaaaagtcatcgccattctctagcctcaataaaccaggggcacaatgcactgcggaaagccgcagggacctctgcccttgaaagcggggtattgtccaaggtttctcccatgtgatagtctgaaatatggcctcgtgggatgagaaagacctgactgtcccccagcccgacacccgtaaagggtctgtgctgaggtggattagtaaaagaggaaagcctcttgcagttgagatagaggaaggccactgtctcctgtctgcccctgggaactgaatgtctcagtataaaacccaattgtacatttgttcaattctgagatgagagaaaaaccgccctatggtggaaggtgagacatgtttacagcaatgctgctttgttattctttactccgctgagatgtttgggtggagagaaacatacatctggcctatgtgcacatccaggcatagtaccttcccttgaacttaattatgacatagattcttttgctcacatgttttttgctgaccttctccttattatcaccctgctctcctactacattcctttttgctaaaataatgaaaataataatcaattaaaactgagggaactcagaggccggtgccggtgcaggtccttggtatgctgagcgccggtcccctgagcccactgttgtttctctatactttgtctctgtgtcttatttcttttctcagtctctcgtcccacctgactagaaatacccacagttgtggaggggaaggtcaccccttcagataataagataaatcagagccgaaaacatagttcattcctgaaatcaaatatagaacgtttctaccaacacacattttcaaagatggtgttttcaggtttgtatgggattgtttcacctttatgaattagctttttaaaacctgtaatactttcttgctgacttcatcatttccttctggttgcctggaggggtggtgtggaatgctaataaaatgaatttcagttgccgtccctcacaatctgaactatagaagatatttattgtctcaacttccctatgagcttttctttgcatcatgcagcttcatggtcagcagacactaaaaattaaagaaagtctttctcccactttacttgtgtagcacagacacactgatcaaatatgttcccagcacttccgaagaaaccttatcacatccacaagagatttcctacttgcactttttttgataaacacaaccatcatagcccaacaaaacatcacacagaaatcaaattatagtgtccccataagcatctgctcctctatggccttgggcaaaatttagaatcctcgacatccctagagttaccacaatctctgaaagtgaaggagcacccacaaagctcaaggaatgcattgaaactcttattacttccaattccattttcaaaaaaagtaaatgtgtgtgtatgtgagctgcacatggtccagaatgcctcaccaaatgtattgttttaaaatgtgtgtacgtccatgtgtaattgtatgtgtgggattttgaaaggctttttatattttattcaaaaaggtacacttttcaatatcacaaactttgctttcaattataagcccttcccattttcaattaatgttttaggcaaggaatatacattagtaaaaccaaccacaccacttagggaaaatgaattagtatggggaaagtgaagaactggccatgcagtcaattactttggccagcatagatatagttgaactaaccagcacaggtgtagacagcctgtttggataaggtagcttaagccccaattttttctgcagtctttatttttgtcaaatatatgaaaactaccatctcatttcctccctgtagctattacccacatgtatgtgtagtgtcaaaataaatggccagagtcctctcagggacctcccttggcacaagtcgcacttcctcaccctctcacctccagagcctcaggaagtgcaggtcagaaagcagccagggcaggtgtgaggtgatggagcgctgagtgtcggcgagcccagataaaacaacgttccaacatcggaaatccaatcattcacctacttgtctcctgctcgctaaccccaggcaagtataaaggagatggaattataacaggagttagaagaatttggatgtgatttcatatattaactcagcaaaattttttctgaaaaggtccagacagtaaatattttcagctggcaggccatatggtctttgtcgaacctactcaactgtgccattatggagtgaaggcagccacagatgatatagaaatgaatgcatggggctgtgttccaataaagctttctttatggacactgaaatgtaaatttcatgcaatttacatgtgttacgaaatatgcttcttttgatttttcaaccatttaaaaaagtaaaaaccattttcttagctcctgggctgtgttgactgacccctaattaactgatatgtgggctgctatccatgaaaacctaggcacagaggaaggcagagctggcttcccagccaagacgggacttaccttgatatgagctgctgggtccgggacagtctgaatcatgtccttcagtaagccagcccatctaccagctgttcagaacctgacggctagaagacaaaaggaacaacatacataataataaacaactgcatttctgtgttttatgttctagcaggacaggacacaattcaccaatggcaaaagaatcatagctttacattaaacatgtttgcctaaaggcatcctctaggtacgtgtggtccatgaggtgactagataactcacttcccttccattgggaaaatcacttacaatgagcccaagagaaccctagtccgacaggacagaagaatctagctcaagctaacccacatcacatgcagcatccacacatccttccacgtgggcagcatctaatgagggatccattaaaggaagacgtgggactaaaacagggcatacttctctatcatactgagaaaacaggactttgaaatcccaccaaaactcatgcgatctgcacatccttttcagctttgttattaagttcttagtaaacagcacagctaccattcattgagtacttcagcgccagttccttgagcgctaagggctccacacacattttctcatttcattccaaccacgactctgagagctgtcattcccattgtccagctgtggacgtcaagactcataaaggttactgatttgtccaggatcacctggttaataagcgacagaaccaaacttcaaatcagattaggctatctgactccagagcccaaaaaaaatttggtttgacttaattagcaggtatcaacccacattttgaagggacattttaaaacaccgcttaaataaattaaatttaaagatgcctataatccaggaattttccagaaataaatacttcatccaatatattcctttattcaaattataaagcagcatgttctgaccactgtctgtgccctccccttccaccgagccagtctccaacctccctttgctgtcacaggccccagggctgacctctacagatgggctcagcagggtgccttgcctcctggccacctgtcagggttggttgacgtggccccctctggagagcaggggtgagaggagaggggtatctcttcccctcaccttcccaccaccgacacctgccgcccaacctccctgggcgcttggttatggttctgactgcagctggattctagggggacctctcccgtcatggggcccctccttccaggctccagcctccagtacctggtccccagccagtctctggtgctctgcagatctcagccaagccatcagttcttttttggcactaaaaatgccttttttagtttacatttttagaagccatcacttgctttttatcacctgtagttttttgtttgttttctcctttacaatggctctttgcagtaacaaatgcaaaataaaaataaacaatatgattacagaacttgagacattttcgaaggctgtctttcaaatttgctactgagcgcattactgtagtgacaagtgaaagcattcacaggagtcctccccacattcacatctgtcctttctgacctctcacggtacaggcacacccattccaacccaattgcctctcatgaagagcatctacctccagatctgcatgctccacatctgtcttcagtctccctggaggcctcccaagattggcggagcttggctcaccaagaagatgacatgctgggaaccttaggcattttttttctataaccaaatttctaggtcttggaaaatatgtacttccccccacccccacccccaggcctaaagtccctctgggggatgagagttactgaaagtacagagggagtgaagtgcagtcctgaaattgaaccgggaagcagatgaaggtgaccaggctcctggtgctctcgtgggagaagaggctgggagaggatggggcctggctgaaggtttctgggagcataggaatcctcaactccccttatcctaagagcagcaggtgccacaggaaaacaccactctgctcctggggtcattcagcccggaaggggagcgtctgcaagccatcctcacaaagggagggcgtcccactgcacaaccctgctctggggagcacatggctatttccgtatgtctggacattctctctggactagttcactccgcacagttcctccctgcctgcacacacatgctgacgctcacaccagggactgaagctcgtccccctcccctcaaacccaggctgacctgtggctgcctctgacctgcagaacacagcagagggaaggtttcaggagtcccaggctcaggcctttatggaagtgggagcttccccttcctgcctcctgaaaccaagtccccataccctcagcagcacagcacatggcagaggaccgagtgcccagtggggcagccagcaccaacgccaggcccgggagggagttgtcctggacagtccagagaactgactctcagatgaccacggcccctgccgacatcagggaggcagcttccagctgagtccagtcagcccacagaatcatgaccaataataaatgggttgttgtactaagctgctaggatttggggtagtttattacacacacaggtcattgaaacaccctgtaagtgctctagaggcacggagaagatagagggtaaatagcttgtttcactgtcactatggataagtacaaagatggttccaacactcaactcctcctgtacccatgctttttgccacataactttgtgattcttcccattaaagaggtagaattacttcccaacccttatttttgggcggcctatatgatctgcttcagccaacaggcagtagcagaaagacaagtatgacagatcctagctgaagcctcaggaggcaggacatgttcccctttgcttttctgtaactttccaccagcatgggaacatggccagatgcatgcgggaggatgagaggtacctgaggcagagtcacccaccccaatcaccccaccaagactacgtttgatcatcccatagacaaccaaaaccccagacatgggagggaggcaaccagaccagccgctagccaagtccaaccagaatggccaacccacaggctcatggctgaataagtgcttactgcttgaagccactgaaatttggggaatttgttacacagcatttttgtgacaatagattactgacatacactttgcaatgtacaatcagattaccgagatcttcgttaaaatttttctagccagtgataaaaggagactcaaacagggcatttcaaaggaagccacttcatcccaacacagagacataatatttccactcacctacgagacatgatctcaaaccctaatcctgccctcaaaatgggtttggaaactgaaggataaccaagaaacctccaccagaagcctccatgggattcccagagcccttcccaggagcaactgaattctcacttcacatgatgccctgccagcctcccctggattccaaaaatcaaaacatccttggatatccaagaccgcagcaacatcatagaagttacagcagccactcggtctgtaaccaaccaagacataaactaaatgagcaactgtttgagtctcttgtttcttatggggaagttttgagtactcaggttgcatcaagtataaaatgacagggaagggaatagatagagattccagatgcaacacagtcctgatccttgagggatcgagatgggaaacagatctgtttcatacagatatgaagcggtcagtcctgagagcaggcagttagtggaggtgcccagtgaggcgtgtggatatacctagaggaaagagagagctgattcatgcagagacaagagggtgccaccaaggagccttgatgaacaagaagcatgaggactggaggaaagagggtgaaaggcatgaagcagggaacctaagtttctcccagctctgccacattagagaccaagggcgtatgagcttctcacaccgccaccaccagagtgatcacacaccaaagggattcactcagcacgcagcgtgatggcactgccaccctccacaccagctcagcgaaaacccaacggacctaaagaccaggagaataaaagctcaaccaccctcccctgcctcctcaacccacacggatctctgactctttttttttttttgagacggagtctctctctgttgcccaggctggagtgcagtggtacgatctcggctcactgcaacctctgcctcccgggttcacaccattctcctgcctcagcctcccaagtagctgggactacagccgcccaccaccacgcctggctaattttttgtatttttagtagagacgggatttcaccgtgttagccaggatggtatcgatctcctgacctcttgatccacccgcctcggcctcccaaagcactgggattacaggcgtgagccaccacgcccggctaattttttgtatttttagtagagacggggtttcaccgtgtcggccagatggtctcgatctcctgacctcgtgatccacccacgttggcctcccaaagtgctgggattacaggcgtgagccaccacacctggccctctctgactctttttgcagccatttgagtgcctgttcttttttaccatttcagaggtattttatggattttttaaagagtacttctaatttacttttgtgttcctaatggtcatttctcaaatatgtagtagttggtaaccaaacaaactaaaaccatactaaaaatttttagtagttggtgatagtttcatgtcactgtaggaacctttttattttctattttacctgcctttgaacccttgcagaacttcactctatgttgattgaaaatcatttctttaatacttgtttcttgcaataaactcatttgctaaggtatatacttccatatgattttgtgtttcatgacccagctatattttattattgggtatcttaaagaaacaaaaaaggccttaacaataacagaattctacttgtgtcacttctttgtttttgttttcaaaatgccaatgtcttactaaatagaaacaaacttgatttgaattacgtaagctctaaccacataaaaaagatggactggtacccaaggtagaagggaaaataagcattttgtaattatggaggcagtattgcaaaatggttaagagaaggcctaaatatttgcagggctggtgcaagaaaatagatggaagtttgagacccctcgaccctacccctcctctcttctcaaacccaattgtgttctgcgggttaggggatgcatatagtcacgtggacatcccgatccacatggccacactccattcagcaatgctccctgctcatctttcagacccagggaaacacacacaagatcttcccaagaagatgaactccaggaaacaggctggtgcagcccaaaagatgctcagtcaagtttggaaaggcactctgggtgccccagcacctggggcatgtcctggaatggggatgggttcagctggggagggcaggaatggggcctagaaggcataggcaggacgctgggctgggggcagtgctcgatatgagcacagtgcagagccagatgagggatggaaatcagatctgccacttactccttggaaacctataaatgatcactttatcctccaagagccttagttacacatttgcacaatgaggataatattactgtagtataataagaactccatttgcccttgtctctcgtttctggcatggagctcctaaaactctgggaatttcccaagtgatgggagcatcttttgttctaagaaggcagcaggttggtgagtccctagatagcttcaggatgggggctaattgcaagaaagagtgagtcttgattagatgctcagaaccttcagccccatttcccaacctctcaggagaggagaggagctagaaattgagttgatccccagtggccagtgatttaatcaatcctgcctatgtaacaaaatctccataaaataccctgacggggttaggacagcttctgggctggtgagcatattggtatgaagagtgtggtgcaacccaatgctaaagggacagaggcggccaggcgcggtggctcacgcctgtaatcccagcaccttgggaggccgaggagggtggatcacgaggtcaggagatcgagaccatcctggttaacacggtgaaaccccatctctactgaaaatacaaaagattagccgggcgtggtggtggacgcctgtagtcccagctgctcaggaggctgaggcaggagaatggcgtgaacccgggaggaggaggttgcagtgagccgagatcgtgccactgcactccagcctgggcaacagagcgagactccatctcacaaaaaaaaaaaaaaaaaaaaaagggcagaggctcctgtacttggaatccttccagaccttgccctgtgcacctcttcatctggttgttcattcatatgcttaataataaactgtaatcataagagcatagcgttttcctgagttctagcaagttgttgcacctaaaaggggggttgtgggaacccccaatgttgtagccatgtcagacagagtgtaggtaacctggggacccaatacttgtaactggcatctgaagtgaggacggtgttggggagctcagcccttaaacccatgtgctaacttccggtagtcagtgtcagaactgaattgaactgttggacacccagttggtatcagtgttgaatgactggttggtactggcgaagacatgatgtatttggtgttgggaaacatgaataaaaaatttgtaaaacctccaaacgatgttcagcaattcacaaaggtgtcagtgcaagagttggcctgtatctattctaactggtcagtatgcaagttgaaccattgtttgattatctcctctgtctacaccatcaggcttttgtgaggattaaactaaattatgcctcagaaagaaaactctctcaaggctaggcacataatcaacactaaacaagtggtaatcattataattaagaaagtaaaaatatttcaaatggacgattttgatactgtataaaatgttgcaacttttttttttttgagacggagtcttgctctgtcgcccaggctggagcgcagtggcgcaatcttggctcactgcaacctccacctcccgggttccactgattctcctgcctcagcctcccgagcagctgggattacaggcacgtgctaccatggctggctaattaaaatgttgcaactttttaggaaaaataatcctcaataaataaattgctaattttcataagagccctttgtcaactgactaaaaacatccttaatttagaaatgtattttttagttttaagataactagtcattaagtgaaaacattgtaggcaaaatggctctaagcaatttagtattcataggaatgaatccattccttgaaagcattggtcgctgggtgcacttgtcctggatgagcagatattaggcaaatcagtctttcaccagcaaaccctgccataagaactgcacaggcctgattcctgccaagcacaccaggcccctgactggggcagaggcctcccttatggggcaggaagaaggaggcagggagaaacatagggcccatgatttaaggaggctctccctctcaggctcatgcaagtgcaggatcagtacctaaaggggagcaccgcccgaaatcctgtgccccagtcaccttaacccagtccagccctggctcctgcactccaaagctaagcagggaataccagcgggagacagaagacagcatgagaaactgaatgcatctcccacatttatctaaaaataagaaaatggacttcttcagtaggaaatggctcatctttccaaatgaataaaaatacttatagctatgggttgaattgtatcaattctctcccccagttcatgcactggagtactaacccccggtccctcgggatgtgatgatagagaggtagggcctttacagaggcaatcaaattaaagtgaggtcattagtgacctaacccaatgtgactgatccacttacaaaaaaagggacaagatttaaagacagacctgtatagaaggacgatggtgtgaagacacagggaaaagacaaaagaggcctggaacagattttcctcaaagccctcagagggaaccacttgggctgacaccttgatcttggacatccagcctccggaacggtgagatgatgaatttctgttgttttaagctacccagttcatggcagtttgttacaacagcactgggaaaggaaatcacctctatggagggacttacgaaagtcacttaactaatgcagattagaggcctcacagtcagggcatggcctcaagagccacatccattttaattgtaccatttctcactgaactctgaccctggtcaaggcatgtctcaggctccatggactactattccttccactgatcgaccctggcttcattctggcaagggagggactcatacattctgcggcctgcatgagtgtcatgtgagcacccccataaccttgatccctgcggtgcttctccaggggagccctagcattccagctggcctcatgggcatgccttagagagagggagctgaccctctccttcttcaactggattttatttttattttttggcatgttttgtgaatacaaagattcactgcctgggtgtgccccttgaaagaaggtttcaattgcattcaggtgaaataaccacaaaatgactgtaagccaaatgtagtagtatgatagaaaaatggaaatatcgtaaaagcaccagtctgtagacacctagcttctggttcctctggaaaagggagaagagagtagacagtgatggagaaaagaggggctgtgaagactatagaactgagaaggcagtaattctaaaatctccacactgtagggccaggaacaggcagtgctgggcaatggggcatcttatctcagggaagtcaagggtgtcatgtagaaccaacataattcatccaagtacagcaaagaatccagaaatggtctgtggaggtttggaaccatgaaaatcaaataggaaagatacaaaatatttacatatccacattttttaaaaggggtcctgactaggcagcataagattatttgggttctgttcattttacctttagttgcccttggttctgccatcttttttctctgtgagtcatttgtcttgcttttggtcaacacggctttcctcgggtctccaaagatcctggaataacctgaatataagttgaagaatattaaaccttattttgttttcaaatattaataccagggatcaactgtacatgtaccgacaaaacctatttcttaaacattattttaaaatatcctaaaaggggaaagaacttaaatccttccccttaaaaaaagaggggacaacattcctctcctctgagggaagcccagcattatgaagcaaaaatcgggagtgaaagcaaggccaagcctaactggcatgctgaagcacacagatgcttttgcacagaaaatattttgaaaatgttttcttttccttatagcccccagctttggtaataatggcttccctagatcattctgttagcactttctgctgctcagaacagggtagtgggatttagaatttagaaaacatcccgagaactgtaattaagcaattgtcatagtcccagaaaagaaacaacccttttactttgtaaatgctaggaggatctgtattttttaaaatcttagaacactaactagctaaaaagatagaaagaaaaaaatctttcttacaatatgcctgtagcacggctccaaaatccagtccctctctctcttcttttttttttttttttttttttttttagatacaggaatttcttacacaactttccaagtaaaatattcaatccccaaataatatatttagtagaatccttacaacatgagaaattgtaaatggcatctgtttccgttgaaaatatttttaaattagaaaacatcttaagcactgcatcaaatcaatatttgtaatgggcagaattatttctaaatggttccacaggccagttgacattcccactctacttaggaagcccccagccaactccacctgaagtcttcgaaacctatgcatagaggcaaattgcccagatgtcacagaaaagcatttgttgtgatacagaaaataaaacacattactgggggaaaaaaatcagggtactaaaccacgtacataatatcatcccaatattgcacaaagaaaaaaaaataagtggatgaaataaaagagggaaggcaggaaaggaaagaggatgacctgagaaaagttatcaaaatggttaacagtcatggtctttggctttccagtgtgaaataggagttcttattttcctctttttaaaatatttttaaaattatttattttttaaaccaactaataaaagtaatatatatttaccgtgtacaacattatgttttgaaatatatatatatatatatatatatatatatatatatatatatatatatatatatatatacatgttggaatggctaaagtaagctaattaacatctgcattacctcacatacttatttttttgtggtgcgaacacttgaaatctactcttagtgattttcaagaatataatgcattgttattaactacagtcaatagatcataggtctattcaagttcaagtcacagatctcttgaaattactcctcctgtctaactgaaattttgtgtcctttgaccaacatctccccagttcccctacgctcaacatcactaatcatcaaggaaatgcaaatcgaaatcatgatgagtgtcatctcacacctgttagaatggccattatcaaaaagacaagtgttggtggggatgtggaaaaagggaactcttgcccaccgttggtgggaacgtagatcagtacagtcattatggaaaacaggatggaggttcctcaaaaacacaaagatcaattacaaaacaaaatactatatgttttacaaatgtactacaactcaatttggtatgtattacaaatcaaaatactacatgattgctggcaatcccactctggagatagatccaaagaaaatggaaaatgaaatcggtatgtcaaagaggtaccagccctcccaaattcattacagcattattcacaacagacaaggtatggcatcaacctaagtgtccatcaacataaacgcccataaagaaaagtggtgcacatacacaatggaacactattcagcatttagaagagaaatcctgtcatttgtgacaacatgaacaaacctggagaactttatgctaaatgaaataagccaggcacagaaagacacatactgcatcctctcacttatacatagcatctgaaaagttgaactcctatttccttctttatagttttgtgtattttccaaattttctaaaccaaaaatattcatctttataatcaggggagaaaactaaggaataatcattttataatcctaaacatgcttttaaagcatttatttcactgtaatgtattcttttcccatccagtcatacatgggcccaaggagctggccttccctgctcggcagcctgatgttcaaggggatgggggagggggacggtgcagtagatcatgctttgcaaagctgtgcaaatcttttttttttttttttgagacggagtctcgctctgtcgcccaggctggagtgcagtggcacgatcttggctcactgcaacctccgcctcccaggttcacaccattctcctgcctcagcctcccgagtagctgggattacaggcgcccgccaccacacccggctaatttttgtattttagtagagacggggtttcatcgtgttagccaggacggtctcaatctcctgacctcgtgatccacccgcctcggccaaagtgctgggattacaggcgtgagccacggcgcccggccaaagctgtgcaaatcttgagttaataaacatgttccccaaatccaaaagccaatattgactattgcttggttaactgttttgcatggataagtggttaaaggagtatttggtttccaatttctgcaaagggaataaaagttttaaaagcgtgaactaagatttcctatactatgctattctatagtaggtttttatgccaaaacctctactaggctgaaaggataatttgatttatggttgagacattgttgggcctgatttaaagcccagagtcaagcccagagaggattctcttaaatatgtgcaatgggtatttttaaattagcattatggcgttattaatatttcatttatcctgagagcatttacctgacaacgtaaattatgtgtaacacagctgagaagccacaaaggatccaaaaagatgtcacgaagtccacgaagagaagctttgccagagaaaggcacactaccagccgcgtgagctggcctcatcaaagcaaaaaagtcagaaaattatgtaaaccagactcaagaactcaaaaatacagtcgtttgagaacattggtaagagtgcaaactgctcaccccagctcaatcacccctggtccagcaacggcagaaagccaaggtcaaggagtcacatgacctgaagagacaccccccaccaccaccaccaccctccaagccctgcccctggccagtgggacaaaccacatgacccctgggattcagtattcagtcaggttctgtgttctgtatggggaggtagaagaaggcaccagatcatcaggaaatctggactggaaatggccaaagctgaacacatctgagtacctgaagggtaagcttaaggtgtcaaagcagccatggtgaggcagaaagaaccttgagcttggggccccaagtttatgctgacccactagcagccaacaaaacctccctcagcctcagtttgctcatctgaaaactgtgagtaagaggctctgactccagagaggtggtgcaagttcaatgagaaggggttgctgatggtccagatggacagatgcaaagcactgctttctgtttttgtctttgttttgatacaggattctctctgtcatccaggctggtgtgcagtggtgtcaatagctcactgcagcctggaccctccctggctcaagtgatcctcccacctcagccacccaactagctcagactataggaaaaagagtcatgcaccaccatgcctggctaatttttaaaaaaaaaattttggagacatgagatctcactattttgtccaggccaatctcgaactcctggcctcaagcaatcctcctctctcagcctcccaaagtgcttggattagaggggtgagctaccatgcccagcaaaggcattgttaaattcaggaatgaatgaccaccttgttccccaaaacactagacaagagaaccattctctacgcacagatctccctggccaccacgtgtaagcagcagtgaatattccataggtggaactggctactgtgaagaaagaaaactccagaaaagctaccctcactccaagaagtagcctggaccccacgtgcgtgacagcagcctggggagaaggctccactcccaccagcaatgccaaggacagagcagcagcagccgtccatccccacagttatggtgaacacagccacagagcagcctgctttttccatgtatagccacacacaggtggcaatggcagcagacgtaactggctgcccttcctcccttatggaaggaaacataattttgcttgggtgttctgcctgcccccacatgacccacggaggatgaccagccccaacaccagtgtaaatcctatcactgggcaccatctcttctcaccacggattggtttagggaagggcacatgatataattctggtcagtctaacactcggggaagcgagctagaggacttctaggaaaagtgttggctgatgaagaaaggccatagagtagtagtcctgtctgtgtggcacttggaactgtgagagccatcccaggaccatgagaagaggtcacctgaggataaaaccaatgtgctgtggatatctgggggaaaggagggaagtccttgtgtttctacctatggtagggaagagtataaaccaactctgaaggcatctcatggcagggcagctaggcacatcaaatgcattttccttgttaactaaaccattttgaattggggtcatttttgttgttattgttattactggcagcaaaagtatcccatacactctagtagccatgttcaaaaaagtcgctttcagctcttttaccatctgtatccatagtcacgcagacacgctgagtatgctcttcagttctaattttaaaataaaatgatctgctggaaattagctcagctcatagatctccatacttacaacaccgtatctaagaattagtaaataactattaccatgataagtggcctatctcagtctatccacatgttgagtgtccaggtactggaggtggcatggaacctcccctcaataaacaaaggctatgatgagaggttatactttaaattaaattactgagtggaggcataatgtggtgagggtcacaagagaggtaccaaagatgcagcaacagagcagttgatgggcacttagcatttcagtaagtgggaatggggaggagagcaggaaaggtggaggaaatagatgaggagaggaaagaagggaagtgttctccaaggaagcacgctgcagggaaagagtctttcacctgtatgtcccacaaggcacagagtatgaactcagaaatgttgaatgatttgtctctataattaagggatgatttcactgataatgttgtcttcttccatgatctaaattcaacctgcccttcaaatccattcattcatacaattgttcatccatccatccatccatccatccatccatccatgtattcatgtattcattcatctatccatccatgtattcatccatccatcatccatgtattcatccatccatccacccatccatccatgtattcatccatccatctatccatccatccatacgcactgagttccctccatgtgccaagcactgagctaaacactaactagggttgggctttgccaatgagttcagagcctagtgagagagacagagttgtaaagaaaaaaatcacaaatgccaactcccccattgccttgcttgatccttaatgccagagtgtagcttggttgagcatgacaatcagctggagagctttttaaaaacagaaattctgcaatccttcctcttttttctttattggaaagtccaggggtgaaaggggcaaaagagtctaagtgggagttagggaggcagaagaggattgaaggcagtgtctgaaatattttcagactgagaaggaaaaggaaaacagccaagaacacaaggaggagcagtcagagcataaggaggaaactaggaaagatctaagtcatggaagccaaggaaggacattcagtaagatggaaagttcagtgtcgcaactgcagagagattcatgtccaggagaaagtcattcaaccaaccatacgcattgagaacaggtcctggatttggcaacttaaaacctcttgctgtcctctaaaaatgttgtaggagcctgacagcattaagccaaatggctcagtagttaaaaacagggaggatatgcaaagggcaatgtaggctactcatagaagaagttgagcaacaaagttagggagggagtggcagttcaaagaaaagcactaatgccacagggtgcagtggctcatgcatgtaatcccagcactttaagtcaggagttcaagaccagcctggccaacatggtgaaaccttatctctactaaaaatacaaaaattagccgggcatggtggtggacacctgcaatcccagctactcagaaggctgaggcaagagaatcacttgaatccaggaggcagaggttgcagcaagctgagattgcaccactgcactccagcctgggggacagagtgagactcctcaaaacaaaccaaccaacaaacaaacaaaaccaaaaaaacaatgaaaacaaaaatgaaaagcactaactggcttcacccacccaacatttgctgggcacttactgtacttcagaaattactagtagctagggatgcactagtgcacaagactcagccctgccctcaaggcatttacaaaccaatgaaaagaaggtttatcttatttgctcagtctgtttgaaggatgagaaaagcaggtatgtttatagacaggataaagggagccagtggagtagaggagatagagattctagagccagggcacttaaggacgttactgtctggggaagaggtagaggaaatgccatgtttcacagcacaatggtggggtcagttctggcaggaaggtgggaccccactgtctcagaaggggtgtgctgccagatggctaacaacaggctctcacaggaaaactcctgatttgaagcacttggtcatttctatggagtcaatatttccatcatgggcaactgcaaggaacccaggggagtccctgaatgcagagttgggaaaagatgtgctctaacgcatcattgccggctctagcgagttgggaggagccagctctagcacacatgggctccagaagccaaagagagaccaagaagcctggaactgttgataagaaaagagtgttcagaggaaagctgtgaagccagcatagccagctgctctcctaggcgctgagaccctgtgatgagaggagaaaccagggaggcggagttccaaatctggaaaagtggcaggcttgagtgctcttcagttactcccacttgagcaattttgctttctaaacctggttaatagcccaaaatgtgggctgcttattgtcatctcccttcactgtgtgtgtgtgtgtgtgtgtgtgtgtgtgtgtgtgcttttcctatgtaaactgctgcaccactaactctgctatactttagaactcagtaaggcaatccttagactcttatacaattccctaaagggtccccttttactctaagtcacagagaaatgttgaacatttaaacctttaaagtgcagttttgctggaagaaaatttcaagggtctccatgaatcatgtctgagccatgtattggccatgaccgcatacttcttgtcagtcttatttcatttggttgttattgtggtttggtttcatttcatgttgctttggagggtcaacctttctttcattcatgacattcaatcaacctttctccccagtgcgtcttcccattttttatgtgtgtgtcaggagatagaaaaataaacacaggtattaatgtgcctgtgggcaccagtttgtaaagcccaagacgttcttggacccaaggaaactttcagttctttctcagccttgccgttttgcatgtaaagcatttgagctgatctcagagttgaggtggctgccagcttccaccagaacaaaacacacagcagcaaaacagcgccatgtccctcagtgtgggaaccagggtctgcctggggcccccctgtaaaaacgagagatctgaaggaaaacagacagcatttgaaaggcggatgacatcaagaaagtaaaagcaactataaatatgacttctctcctgctttacactgagccttctgttcaagaaaacacatttaccagggattttttccttaagctcaactggaaaaacaaatatttagtcattttacaagagcagacaactgaaaagcaagccacagattaaacaagcattatgtatttctaagaaagttcatcaaacacaatatatctttgagaacacaatcttgaagtctgttttagaggcaaatttgaccttcaaaatgaattttgtctcgatataattacaaggtcaaatcttaaagaagcaaatgcatagacaaccatctttgcaatgagatctgttttatatttgcaaatgaacaatactggacagaaaaaaaatacataattacttctgaggttatatataaaatacccaattggcaattagctaatatcatattagcatctcaatattttagataaagcaaaactcccaagtacaaaataatctataatagaacaaaaatggcaagtcatattaaagagagattacatataagagactttattacaagttatcattttttagataaaatttattctttcagcatcactttgatacttgtaggaggcagatatagtatagagaggcagatagaggtgagaacctttcctaagaaaaatcaagcagcattaaaagcataaagaaaaaagaagaaaaaatatttcagattcccaattcgtatatcacattgttgacaaaaaaaaaattagagaataccaacaggaaaaggtttccttgtgctctttaagggtggggaatttcaaagaaccttgaactcatcatgaaaatagttctatacccatcggctttgccaaaaacactttgggatttcagtgatgggtactgagccaccaggagcaatgaaaccagcttttccatttccactgagttttgactggtttacaaggattgcacaaagatcacctcatttgtactggacacaattgggaaataaaaatttaaaaatcatccttcatatttaaaatagaaatcatgaaccccgccacaaacatgcttccccgacactcaggacctgaggttgacaacatgcctccccgttaacccatgaagcctcataggtatgcactgcatctatatagaattttccatggactccatcatcaaagcatcctttaacaagtatgaactgagcactcaccccatgcacagagctgtggacggggccatatgggacagaaaagttgcaaggtgtgtctctcactcccaaagagcccacatgccttgcaggagaggaaggctgtggacccaggttttgtgatgcagatgaaggggccacatagctgctccagtaagaagaactggaatcatctgaaggagaggaaaatagggcatttcagccttgaatagcagaacccagatcatgaaaaataggaagaacttatatggacgtcagagaggaaggcaatccagacaacaataataacttaggcaaaacagaaatcaaatgcagcttgcagaagactctgtacagggagccaacacagctactttacgtgaggagtcaatgagaccatttaatagaagccccctgtcgaaactgtaaaaatgattttgccatcttggccatctcctgagatggctgagaagggatttgccaagcaaaaaaagagttgaggggttttgcacaatggcctggaacagagaggctggagagaaatcagacaagtctctcaggcagaagttccagaaaaatgaagaagcaggagagcccgaggcaagagggaaatggcaggcacattggttggacgatgagggtttgtgtggatctcaaagggccaagacgtggggagagtctagacttttaggctaggaagtccgaaccttgttgtgaaaatagctgaagattttggagcacctgccgagcaaagtttcccaaagaggctgttgggaagattcatgaggcaggagactacagggagggaaggccagaggcagagaggccagttccaggatggctgccacgatccagcccaaggtaatgaaggtggggaagcctcggaatgcaagagacagggtggagatgagaagacatgtcagagcctggtggccaattaagcagagaaggtgcagggaagagaggagagcaggatggaaagccaggaaatgtgggtctcagtgaagatggggagttctgtttcagccccaagaatgagcatgtgcatccttgaaccccggggcctgtgaggttggtcaatggaagcccgggagctctgctcagtcagggtctaggactggtactcctgctggggccacctcagagcagaagcagggcgggagcggtggaggctggctctgaagtgttctgcccttaaagaacagcaagactttccagaggcagtgtgtagcctttaagatggagactgtgatgaagaatggagagagatggaaagagcttctcagtgacatggggagagggtccgcacctggagggcaaacccttcctggagggcagaacctcgctggccatctggcttcccacacacctgcctggtgaaccaacatatcactagggggttcttttcttgcttgaaatgtcattgagttttcaatttgtagcattcatgaggtgcattatgaggtttattcagcattttttttcttttgctgagaaaggcacaattaagtaccagaattttctttgctggcctagccttctggaatctgaacaggttttgcaatcccaggaccagatcctctctatataaaaattggtgtgggattggggggggggggtctctttttataatagctagaacatcttaatattttgtaaaaaataagctcatcacgaacccagttaacccagcaaggctactgcccttcttctgtgtcgtggtaacagctttcttcagcagtgcaaggtgcaggcagagcctttcatagttttaatcactaggtccatttattgagagagcttgaaaggtgattattcctgttctcatttctcagaaaactgaggcatgtgaagatcacaggtagggtaagcaaatgaacacaaattcaaactcggaattcaaaaccagcctctgtgtattcctgaggaccatactgtctgctaagtgtagagaaaggcacatcctggttcaacagcagagaaagcaaacaggaggcactttctgtgagtcatctccaccacagggccctctcttttgtgatccagcgatacttgttcacagtcaaagcccaggaagagtggaaagattaacctttgtgagccaaaccgtgtgacacttgattacttgacagaactaatccttctgtcctgatgacagaaattcaactacacaggtacatgcaagctaatatctgttgtaatgcctcccagtttctctggagaattccttagtttcctggacatctctgaaatgcaaagttttggcaacgagtctctgaattaacctctgaaaatctcacccagccaagatggccttcttgagaagactgaagaacatggttggtttcaggctgagctggaagtggtttacctcccaggagaggttccccacagtggtgtttaaggcatggggtggaccaacaccaggaagactcagacatcacaccacccaccttcaactcagtcacatccacctacattttctgaaaacaaaaggcagtctccccaaaaagcactgagactcttgtgtaggtaatctgagcagacaccaacttcccagggcttccttttatccaggagagcttggctgttctttttaatggtaatatcttcttcttcctgcagcaccgggctgtggcccactctggagaaaaggaaagatcattgctggcctgccttcccaatttcagacttgccagtctacaattgtgtaaactaattccttaaaatacatctcattatatctatcatccatctgaatctagatgcatacatatgtatatacacatatgtacacagttataaatatggatcaatataatgagatgtatttttaagaaattggtttatctgtctatatatatttacatacatatacatccatacatagatatctcattttatctctatatctatatacatataaacacacgtgtgtgtacatttatgtatggacataaagatgggtgtaataagatttattttaaggaacttgaaatatagagagatatctatatatatctacacacacacacacacacacacacacacgcacacagagaaagagagagagggagaaagatctatctacatccatcctgttggatctttctggagcaccctggctgacactcctgcattgatgagtcattggttgtaggatgtcctgggaacgaggcatgagcttggacagggctgtcatcatcagcaggcacttcccaaagagggctgacagctgaggcatcttccaaccatactcccagcatctgagggaataagtccttccttcctgaagggaacccagacagcacatcacagagcccacaccaactgggcaaattgaatgtgcacagagtaaattaccaaaactgccaataaaactcagaattataaaatcatataatttagaaattataaaatcatataatttagaaattacgtgatgtaattaacatttgcaatccgttgacttaaagtcgattatgtgggaaataactgagagttcgttaataagcacaaaacaatccagcagaaattgacagcattaggtgctcaggttgtgtggaggtcaatctcagcaaaccagagtcactgggctccctagatggagttaaggaaagccctgatcttggaccagccacgtcctttacacatagcaaggactgtaagcccgaccttgctctagcacaggaaggaggagggcttccctctaaaaaccacccattttctcccagaaccccaagactccagtccctgtcaggctgcagaggtgatttccaaccatctgatgccacctgcatcagaatcgctgaggcattcctgggccccatgccccattcctggagtcagcagccggactatgagactggctcagtgaaccccacagacagggtcacaggcatggaagcgcaggcagcagagtgcaggcacagaggctagcagtgaccatccacctggccctgaacaagtccaccttctcagagttttagtttcctaacctggaaaacagggaataatatcatgaaagaaacaccaggcacagcactaatgtatcacaaatgccacataagtaactgagtgcaaaatgggacatttcctgccatcggctgaggctcagaatagcacacagagcacagcagcggtgcactctctaaaaaaggatgcccgcacatccatgcacaactctctaaggagtgacctaaataacaacagcaagtccctgcccctctgccttcccggcctcaagggtatatatgtcagaaactggtcaatgctgagtatacagctcccacagtcgcagaggggagcagggtggatgtgtagagttttctggtttctgcacagtataaatcctcccacaatttcaatcaaccaaaggaggagttgggagacatctgcacaattagctcttgtgcaccggcactgatagaagagaccagagacctggcattccttcagagaaagtttcagaggctgtgcagcacctctctccaccccagggaaagaaaggaaagggggacataggcagggaaatttcacatccatgtgcagatgcaccaacctcaaggccagtgagggaagcttcaaaaaaaccatttaggctgcctccaagggttcccctagggttctgagctaccagggcacaggggctagtgactgccttccaggtagagaagtttgcagaggctgcctggggacaggtaagaaggagaggccatgggggggcacactgagcttccatccatggtgaggtgagagggcctgggtatatccttgtacccagggacccatggcaggtggctggacttgcaggggtgagccagccctgacagaaagaggctggaggtgtaccagggtgaagctaggggaagggtaccatcagcagacacacacagggatgtcaccctgccatggagagctgtggggcaatgtcactgcaagagcccttccgcaccctcccatgcattccatgaacaaggggcagcttttagacctttgcttcacagaggggaatccgacaccaaattatgatgcatggccaagtaaccccattaatagcccttgttgtcctgtcttcctgctccaaccctggagaaccagaggcagaggtcagtggtaaggagaggagtgggtgtgcaagcctctgaggctgggagccggccatggccccagaggcgtttccgatgctaacaccagctccggatgcaaagaatcttgaaacaggacgaacaataggcttttaaaaattcaacttccctggacctctcaatacttggaaattagactgttcactgtatctagaagtgacagggaaagtctggtgcctgaggagactcggaacagggacaggaaggagctatcagacttgaggcatgagtttggaggaagtaaagttgcacctacatcataacctactgagaacagctcattcagaaaacaaagaagcccagtttctcatatgttgggtgggtggccctgccaggtaaacctgtagcaaagccacatggaaataggatagtgtcaaaaccaatcaggccaagagtgagcaacagcccactgggtctctgaaagagctgaggaaacaagaggaggcaaaagaagtgatctataaggcacgaggttggtgacagggccaggaagtttacaagagcgagcatatcagatagacaaacaccaagaggcagaagagtctacagatacaaggagatccaaacctacccgcaatccccacccaaccccgccccggctttggctaccctggggctggcgaaggtattaagtgaaaacacccaggtttgagaatggctgggcatcaaggcagttttgacaacctcagaatcaggaagtatttgcctgcaggccagtagctgggagaaatgtccagctctacgtagatttctgtagctggggtcccattttccttcaaggtgggatgggtaagacagaaaacgtcccctgaaggacaagactcaggacagctccagcctagtgtctcccggtccctgtttgctccacaggagaaagaccctccagagtgcaatgaaggggcccagaggggacagtaaagggaccccatcccatgtggcgactcccatcatggcagaactgtagaatccaacatcacatggacctcattgataacactgaccacacctccttgctcttaagatggataaagggcagggacaaggggctccgttttatttgaccaatagctgcaaaagtaagaaatcgtaataagcatggaatcacagaaccagttgaatgtagaattaaacaattaaggcacatttctggcttaaagatgccaagaggtttttgtttgtattctttatgttttttttggacaaccactaaacacacattcagagcatcttctataagagccacagagacatcccttgagacttcagatgatttcaaaactctgctatcgctccttgaaaaaggcaagcctgggattgcaacctatccatgcatctaaccccccctggaaatctctggctccaagagtctaatggtgatggctgccactattagatttcctttctctctgggcattacaatcaggtttacaaggaagaaacaccacccagggttatcacctccaccagtggacacagagttcaccagcttttattgccgggactgacagatgtcaaggggatcactggattccaggattgacaggatggaacggtcagtaggacgccttcccccaacaactcagatgacagagtccacaacgcggcagccagatcaggcaggaatcccacctaatgtctgaataacaccactgataggaatccccactgaatcccaactgaaggctcagttgtacactgtgggcccaaaatacctacaacgttttacaaaacctaaagaaaaggcagatctctttggtggcaaaggcaatgtggtgagttaactttgaagcaatccaacaccatattattgtcatagacatgctcactaagaaaaaaaaaatcatacagagaaatagaaaaatagagagataaatgaataaatatttattttgaggtttcactgccaaaggctagccagagaaacaggggagatacaaggtgaagattggaatcacaactaaatattgttcctgtataaggagaattttccctgtttgaattcttagattacttgactccccgagtttctcattcctttgacaggcacccatgagtgttacactccaagcactcaccctcctatttccatgtgccagcatttccagtcactatcttgatttaagtagagaggataacagttttctcctacatagtaactttaaaatagtaacagttttctcctagaagcaacttaaaataaatttattgacattaaaaaattttaaatgaggtgtagtcaaagcttaaccagcacttttttaaaggagcatattttactttatttttatttttatttttattttgagatggtgtctccctctgttgcccaggctggagtgcagtggtgtgatctcagctcactgcaacctccacctcccagattcaagcaatccttaaagaagcatatttcataaagaacacttctgagtcacttctgttgtcttcctgagtgctttttacctgctctttgcatgtggcataaactcctgcttctctaatgcatctcagtttttaacttttggctctttcactgcaaacataggaatttttaaaataaagaaaccacagccaggcatggtggctcacgcctgtaatcccagcactttgggaggctgtggcaggtggatcacgaggtcagcagatcaagatcatcctggctaacatggtgaaaccccgtctctactaaaaatacaaaaaaattagctgggcatggcgatgggtgcctgtagtcccagctactaaggaggctgagacagaagaatcccttgaacctgggaggcagaggttgcagtgagccaagattgtgccactgcactccagcctgggtgacagagcgggactctgtctcaaaaataaataaatacataaataaataagtaaaccaaaacagttgtacaaacaccagatattcaaacatcaaatgacttgataaatgtggactttaacggggcaggggataaggaagggaaatgcagcaactggtgcatttacagcaattaatcctccctcatcattaaaaaacactgctccattttgtaaatagcagcacagagcaaccacactggagaagtcatgcttaacaatacattcatttgtgggctttgtgatttttttccctctcaagccattttgaagaaaatctttgaacacgtctcagtggcttgatgcttcacattaagctcctttaagcagctagaagtttcctgaaggaaacacatgagccttttactcctagaacgccaagagctggtggagtcctcaagaaaaaaacgacgattccagtgggaatgaatttccttctgagaagtgaagggcaaaccacattgaaaaagttgagcttcatgcctcaactcagaaagttaacctagccagggtccaggcaagaacaaaatctgccagaaaggcagggtgagctcagacagatttcaagcaggagcacaggcaaggtaatgttcaaaatcctgtccagcccccaggtactatgaatactcaatgacatcaaatggagccagttccaaattgctaaacttgtagctcatagctgggtctcctcaagaacttgtctttagacccctaaagacacctctgccacatgaagagacccgaaacgcagcttacatccagagcaagtcctttgttaatgaaaatgtgaatggcaaagacatcaaggtctctagcagtggccatatttgaacatgttttaggactttcagataaaatccgattaaaacaaacagattggggccaggcacggtggctcacgcctgtaatcccagcattttgggaggccgaggtgggcagatcacaaggtcaagagatcgagaccatcctggtcaacatggtgaaaccctgtctctactaaaaatacaaaaattagctaggcgtggtggtgcgcaccctgtagtcattctttgcagttccttgctctggggctgcatgaaggacttccacctgtgaaaagaagtggcgaatctggggcccatcattggaaatgccagccttctcactgagtctgctattttgcaagaaaaatcaccaacagcattccccttaagtaagtctctcgagatatcacccaaggcagggaatccccaactttgctcttggatcaagaagggcccccgataaggttttcaatcatccttagaaaaataggaggaaagcggaagaacagtactcttaggcgaaattaacataactgaagtcacattcttttgaaactatgtcctcagatttttgggggtggaggttaaagtgtcctttatttgctgaaatgctgatgaaattagagaatagaggttttcctcctttgttaatgccttcacgtattggcatcttgatttcctccttttaaaaaatgtactagttttggccgggcgcggtggctcacgcctgtaatcccagcccttcagggggccgaggcgggcggatcatgaggtcaggagttcgagaccatcctggctaacacggtgaaaccccgtctctactaaaaataaaaaaaaaaaaattagctgggcatggtagcgggcgcctgtggttcccagctattcgggaggctgaggcaggagaatggcgtgaacccgggaggcggagcttgcagtgagccgagatcgcaccactgcactccagcctgggcgacagagcgagactccgtcaaaaaaaaaaaaaaaaaagtactagttttatgtcttaatagcaaatctccattctaaaatgtctacaaaattatgagaattttattatatacatgaaaacatctattatggaataaataggagaaaatgtaaaatattatgtacagtatgattacaataagaaaaaataatacacaaatgtaaaatgaagatagttacacaagggtggtataattgaggcaattttgagtttttaaataattgtttaatgtccttaaagcattactttttaattaaaagaaatttcatgtgaatgttattataacagatttataatagactttttaaattacctaccaaagcataaacatttatctctacagatattacagtatgcctttccaaaaatagtcaaataaatgttagctcttctattaccagtataatgtgtacattgttagtattactgattgtgtcctgtctaagtacgaactcaactggcatatccacattaggtcctgaagaatggcctcagccttactcaaggaccgttctctgataatgtcagcttgaatagaagcaacttaaaaatctccatgcaatttctattagcctcactcatgctgctgcaagatctacaagccatttgctcttgttgggagtgtgaaatgttaaccagaaagtgtacttattatagggcgtattatttcttttcttgcttgcttctttctaactgaagattctgctctcgttccccttaaaacaatcttcagtgtttcctagatgaaatatttttctccatctgtcctctcttccagcttccacacagttgtagacttactctcttgctgaattttcagtttttcctaccaaaataccggctatttttgttctctccttccccacttctgtccactttttaaaccatcaaaaagctatctatactaccccaaatgctttcaacaccaataatacaaaattatattaaaaatgtgatcttggagtggcacagtaaccattgtcacggggtcacaaaaatcactgtttttaaaaaatggtttccctcactgaatgcccatgctgttcctggacttcactagaagtacaataaataatcttcataaagaacagtctgaaatcaccacatggtagactcgcctgagacaatcaggccttattccaattacaagcacgttgaaatgctagagaaaatctaaccaccaccaacatccaccctgcccccaagaaagaatttacatacattacacacatggccaagaacaagagaaagaaaacagaaagccccaaggtccagagtcaaagaaagaaattcagttagcaagtgctagctgaatccacaggaacccatagggatttgggtcacaagtgcaagtcctaagcactgcgggtggggttccaaggcccaagcagggacaaaggacacagcttatgacccaagagaagcaggagagcaaagactggaacctttcctagcaaaagtagctgtgtgcctaaggctacgtgcagcaaaaacagtcatctgtgagaaataaaaaccacatttctgttacttgtatggtgtgttgcagcccagatagatgatagatagatgatagaaagatagatagataatagctagatagataaatgatagatagataatagataaataatagatagatagataggagataggtacgtaggtaaataggtagatgattgatagaagtaggtaggtagataggtaggtaggtactagatacatagatgattgataagtaggtcattagacagatgattgatagatgataaatgataaatgattgataaatgatagagagagagatgatagctaggtagataaatgattgatagaagataggtagataggtagatagatagataaatgattgatggaagacaggaaagtaggtaggtaagtagactgatgactgatagatagtagataggtagatagatgatacacagaagataggcagatagataattgatagaagataggtaggtagataggtgactgatagatgattagatgtatagatagatggttgatagaaagatgatagacagatagatagataaactgattcatgaccaactgattcaacacccctagggctctggcagaagcaaaaataaaactactttatagagacactttcatagcttacattatagagaattcacaaagaaagaacaatcctcactgaagataagctcacaagaaaattttgtaaagtacatgaagaaaaaaaccaaaataagtagattttagtagatgtagtagatacaaaaagattgaggattagcaccccaaacagcatggataaaagatcaaacaaaagcatctataaagttaatttaaaatgactttttaaaaacagaaatttaaaccataataaaaagcagcagagtataaatcaataacagacagagctgaaataactgaagacaaattccagaaataaaaatttaatagactatcttaaaattagttattcaaaaatggtaagagaaattactgaactacctagaaagaaggaaaaacagagatgttaaggagtgtggaggctagcatgagatgtccaagtgaacagtgaaaatgagggataaaaattattcagaagatatatttggagataaataataaccagattttagagaaagaaatgagacttcagatttttttttaaaaaaggagtcctgagcaaaataaacataattaaatccacatctagtcatatcatgataaaacatcaaagacaaagacaaagtattaaaagtgaccagagaatagaataaagattatctacaaaggaaacaacctgatggatacaagatttctcatcagcaacaacagacgccagaagggaataaaataatgccttcaaagtgctgctggaaaataactggcaacctaaaattctacgtcaggcaaaactaacattcaagagtgagtataaattgaagaaatgttgagggaaagaccaaaagattttactacttacagacacttaattaaagagctattagagtatatcttcaataagaagaaaattaaacccagaaaggaaaaaaatgaaattcaaaatacaaaggtaaacaggctgggcgtggtggctcacgcctgtaatcccagcgcctcctgaggcagtcggatcatgaggtcagaagatcgagaccatcctggccaacatggtgaaaccccgtctctactaaaaatacaaaaaattagccgggcatggtggcgggcacctgtagtcccagctactcctgagaggctgaggcaggagaatggcatgaacccgggaggctgagcttgcagtgagcccagattgcgctgcaccactgcactccagcctgggcgacagagccagactccgtctcaaaaaaaaaatacaaaggtaaacaaagacaattatgagtggatatatatgcatcttaaattcaattttaaaagaaaattatgagttgataaatcaagataagcattgatacaattaaagagataatagtaatgattaactttagaaatcattactaaaacaaagcagaactaaagaactaggtaacagtaacctgagagctggaagtaggggagcagagtcagagggccttggatcgtttggaaagtgggtagaaacaatgcttgatgtcagactttgttaggtgagggataattagacaatcgtaagaagagtctaaccagactaaaattagagtgtataacattcccaaaacaggagattgggataggcagcataaataaatttgataaagtcaggaaaaatgaaagtcacaaaataagttgacagtaacaactacaaatatattttgtatatattgtaatttacacaatatataaattaatctcacttgtcaaaacataaatattctcagcctggatgatttttaaaaatccagttatactctgtttatgagagatgtatctaaaccataaataaacagaaaagtttaacatacatttactgaaaaagatatacctgatataacataccaaaaaagaagttcagctatcaacaaaaagaaagctggaatagccactttactatcaggacaagttagactttaggataaaattatttattagggataaagatgagcaaagcttggtaataaggagcaataattcatcaagaagatataaaactccagaagctgtgggcaccaaacaacacagcctcaaaatacatatgcaaaaatcaacagaattataaacagaaatagaaaatccttcattatagagagaggttgtcgctctcacctaaacagctagattaagtagacaagcaattagtacaatgattctcagaggatgctttgtgagacttcacctgttgcctgacatttagtggccaggacctaaagctgagggtttggaggtgtctgggaccccacattctgaattgtctgaaagaaaagtcagacaatttctttcaccctctatgcaccccacatacaggggcaccagaaccagtggggtgggagcaaaggggtgggtacaaacaatggaacagacctcaccctccagattcccacagcccatcccccatgtcttgggaggcggtttagggaggaagaagggtagaatcacgtaagatcttccatgggttttaaaattgcatatatttattgaaagtatacaacaggatgttttgaaatactcatctggatatacatagacacagcacaatgattactacacagtgatactacagtcaaacagattaacatacccatcatctcccattgtcagtgtctttcttggggacaaggggatggtaaaagaacctacaatccatgtaagagattttattagaccagatcagacttttaagtgattaaaggagactggaaagctcttgaatctactccagacagtaacaagggatgtaaaagagagatctgtccaaacgtggatgaaggcaaaggggaagaaaatttgctgaatgcaccacttatacaaagatctgaaaacacaacaatccagctagatctagcaggcattaagggaacctgaaccaaactgaaaatacatactattttcacgcccatgtggaagatttctaaaaacgacatagtaaatcccaaagaaagtatccacaaatttcaaagaatgaagatccacacaacacgctccctcaccacaataactcgacactggaaaaaaacaaaggtatctcaaaaaaaaagacttaaacttaaaaaaataaaaacaattatgaggcaatcaaagaaaattatgaaagaactaaaccaccacaaaaatcagtacgtgaactcaatctacttgtattcatatggataatctcaacaacataaccttgaatgaaaaaaccacttgcaaaaggatatgtatagaataacaccatatgtgcaaaattataaacacatttatagaatacacatgtgtgcaggtgcacatgcatatgtgtgaaatctgtgctgtatacaggcaaagagaaagcagagtcacgtgaacaggaagaaaacacacccatttctggataccaaatggaagaggaagagactgggcaagaaaaggatcaaatgaatcatgcactctgtttgtaagctgtgtttcttcaaaaagactcagaagacaatacaaccaagcattagcgtgtgttgaatttggtcaaaggcgtttttcgttttattatgactggacttttgtatatttcaaataaatagaattaaaggagaaaagttacttaaatgctccaagccatttttaacacggcttctgctcctctgagcacctggctggtgcctttagagtggcgagagatgagaggccacaagggaaggatggagggagattcaggttcacaggttctttgcaatttaacatagcaacgctgcgatcactattcaaacacacagcaagtaatggatggcacttaatatgcacttcggtttcttccactgcccttgtgcaaagtaaggcttcccagaaaacaataagaactaaaatgttttcctgaaacaatgctagattcctaaaagcaatacccaagcttgagccataatgggttcaagggtggtggatgaaacacatcttcaaggttactgttagttcactgccatgcgggcttctatgcaaacggcaacattcaccatccaagaaagtaaagagcccagactcagtctccctcttccacagatcaactgggcccaaatccatccacttctctgcattcagctctttcattagtaaacctgatactagtagtccacgtgcgcgcacgcgcgtgtgtgtgtgtgtgtgtgtgtgtttagcaagaggggcttgaattcctcaaagtctcaatgaaaactcagtgtagactgaagcaggggagattgaactgcaattgtaccagtgcttaaagacaatgaatgtttgatctgagcaatcattctgtgctgtggtgtgagaaaggaaacctacggagtaatacccctccttcctgtgaccacatgggctggactgtgcatcttggccacctctaatgcaatgcaacaccaacccacgctgtgtctctctctgtccttggcgaggtcctacacacaatgcaaggaactgcttcaccgcactggccaaggacaacaagaataggcttgaggggagattgaaaaagaggaagaaagtgtttcacacagaggagaaaagaagttttagattaaaagagccctcatcacttcccatgtgctctcaccataactgccttggagggaagcaatccctgctatccacaaaccagcaggactggcagaaggtggaacacagaggtaatcccttccaggggctcagacccaacacaagggcttcacccttggctcacttcttctcctcgtgccacgcatccaaaccctatgcagaataacacgcatgccctcatcaccgcccacctccccacctccactgcaacgtccctggtccaggccactgtcacccctcaactggattattatgttagcttcccatgttccctgcttcaaaccttgaaactactgtccacaaggcaaccagcaagatctcccgaaaacatccatcagatcacatcactcccgctgctcacaacccgccaatgctgggcttcccatcacacagacccacggcccttagggaacctggcagcaccccttcatcacgtggcccctctttctgtgacctcatctccactcctcccctctctccatctggccgccctgacctccctgctgctcctcaagctcagaaggcaactggcaaggcaactggctgttccatgtgtctggaatgttcttccccagatagctcccggctcccccttcgcctcccacaggccctcactccagtgtcagtctttccatgactgtcactctataaaatcctaacccccaacactctccatttgctgcctctgcctcatttttctctccttagcatttatttccaccacagcaggcctttgctcatttgtcttattgtctgtctgtctcctgcctgaggatggggacattcatctgtttggctccccgctgcatcctcggcacccaggacaggggtgggcacggagtgggcaggcaataggtgtttgttaatggaattctaaaagtaaatgacaaaagagaagggaggtgaaggcagatctttgttttctggtttataaacttagtgctgggcaggaggaaaaaaagcggggggttcatgtgaagctcctttcctgagtcaacatggtgatttaaaataaactaaatttagttggagaccttttaaatcatttttctcaagtcagttatatgtgctctagctcataaataggaggaagaatgcgggtgacattcccaagactgcagcaaatgtcggccaagtgaaaaacacacagaatgtcctgaagatccagcgacgtcctgaatgtgacgcgttccagttcacaaaagaggagtcacaaaatgtttacaaacctttaccatcccattgaaatggaccttcacattttcctcaaaaatagctttctaaaactgttactggtttacattaattttacctttcttctttttttcccctttttctttcttattttagaaataaagtaataggattagctttttgattaaagcatattaataaaattttgacattttatttgatttcaaaacatgttccagtttccatcattatagtgggtcctgtatgccatgtttatgttttgaaaggctgaaattatgtgtgatcaacaaatttattttatatcaagagcatctgtacatattaaatcctaaatgtgtcttgaaaaataccccctcacctttctctatcctgcattttatctgaagcattgtaagtcttcatgaaaaacagaggaaaaaatgaaacacagtaactaactaggaaccattagaattattttctttgacatttcctttttttttttttttttggagacagagtctcgctctgtcacgcaggctggagtgcagtggtgcaatctcggctcactgcaacctccgcctcctgggttcaggcgattctcctgcctcagcctcccaagtagctgggactacaggcgcctgccaccatgcctggctaattttgtatttttagtagagatggggtttcaccgtgttagccagaatggtctcgatctcctgacctcgtgatccacccaccttggcctcccaaagtgctgggattacaggcacaagccaccatgcccggccctttctttgacatttctaagcagtagatatttgcaaaccatgttaacgatctgtagatgtatattactaacaggcggggcccattgaaatcctaactcttctccatttgtttgctgattcttatcagtttaaataaaatgttcactcttaaactacattttaagcaccgcataggaagaaggtgttcatctgaggaagcagtgaacggacatcataaacttagtcaagactgtttagtaaaatcacaaatagaccaagcagtttcactgctgtgagtttaaaaaaagaaatcactgatctttagtcagacatagttttctgaacgaaagttagcacacgcggcccctttccagtctacagttgacatgtgtcttctaagtgactagactatgaaacctctaacactctcatcagagttaattcagagctagtcactaaagcacgccccctgaccacatcgtaactactgtgaaaagcagtccttatagaaatcatgacgttcttttcctttgtttgcagtaggttgttcatcgttttcatgagaacataagggccctctcccaaatagctcagtccccaaaatgcagacatcagcaaatgacagcaggtaacgcctgcagactggtgctcgccgctcactgtgaaggcaagcaggcttctgcctcagttttttccccctttctcctctgatccattccaatcaacaccactgacagtggacagactgctgtccgggtaagagtgagggggacagagggcctgaagttgctccattcgtcctcatcacgatgggtaaagaagggacttcatgtccatgtgcagttagcttccaaaagacaaggaaatctcccacctagaaggggacccccccaataccaaccacaggctgggccccccctcttcagccggcccctgcccaggtcctgctgaccaagcctcctcaggacacaaggtcagttcaggacttcagtggcctcatcccttgcatcccaccttctgagttaaagtctttcagaaatacagcaccatgggcttctagagctgcatggaaccctggagatcatcccactccactcgttgaacagtgggggaagccaaggttcagcaaacgggattcttccctcaggcttcatatgcaatggaagggcaccagctaaaagctaagcgctttgactcagagccaaagaccagggacctttctagcaccttcctcctacatataacttatatgtaggagaaacagttgtttccatgagcccatagaagaaatgtgatgtcaaagtatgggagaacgttggatagcattaatgtctagtcaatacacattctccccttgttcttacaatgaatcccaatgttgttcagggccacaatatcttcaggtacaaattacattcccaggcttccttataagatgtggccatgagagggagttgtggcctaggagatgtatgtagacatctactctgggtttctgggaaatcctgccctgctcttcctcttagggacaccctcctacctcttccatccttgggaccacgcagatgaaaccacctgcaaagttggcaggcagtggctagaaggcgactgggatggatgaatggcttccttgagcagccaccctgggaccatgcagatgaaactacctgcaaaggtggcaggcagtggctagaaggggactgggttggggacgaacggcttccttgagccctggactggtccatgattgctcaagtccaggtctctccttaggcaagacaaacacacatgtggggaggaaggccaatttatctgatcggtgagttgggaagaaaagacacagcatggtcagcgtggcctcagcagggagtccctcctttggggaaatatcctgtcccaaggccaaggtattattctggttggccattggatgagattcctgggacaggctctccctctgggggaagcccaagattgtccggctctactcagcacaaatgtgtaagtgtgtatcagaggtgaagtatcagaagtcttaggtatttaattattattaaggcaaagattacatcactgcctgagatacccaaatcccatcccaagcaatttcctaacaactgatctcataataataacaatcttattatgaaaaggccagtgcaaattgattcttagagacactattattcagtacaacaagaatcagaaagtcaccataaaaccatggatgtccagttaattcctcaccttactaaagcaaataaactgcctttagaattaaactggcaataccagtgctgccctcaaaactcactgctgcctcaccaatagataaaatgtcacatgagatgatataaaataaatggggagatgcggaattacctcactgaataaaatggttatctgaacaaaatgtcatgtgaactgacttgtcatggagcctaaaatttcttgagtcccattcccttaggtgaaggtgggaaggcatctcaaaaaatgcaagcatggggctttgaaaaagtcttcaagtaaaggaggcagtaaagcaaaaagggtagaatcatgagctttcttcagttcagagttagttctggttctggctctgacatgtactagttttgtgacctttttctaattagtagacaccatctcagaggtagctataaagattttgagatgaagtctgtaaagcatctagtatgtagaagcatagaataaatgatagctgacaattattagagtgattattatttagagtgtctggcagtggtgtgctgacaaaagggtttttgaaaaatcatttgtttggggaggaagccctggtttgtactgactgccaatttccatggtgtgaacacttccattacagtcaacttcaagctaccaatgggatgtcactgaatgcagagttgagaagagatgcatacagtcagctctcaggagctgccaagagtcagcaacagcttctctctggttcaggcactgtagtcacacctattgacatggtttggttctgtgtccccacccaaatctcatctcaatttgtaatccccacgtgtcaagggagggacctgtaaaccccacgtgtcaagaaagggaggtgattagatcatgggggcagttcccccatgctgttctcatgatagtaagttctcatgagatcagatgattttatatgtttgacagttcctccttcacacactctcctctctcctgccgccttgtgaagaaggtgcctgcttccccttccaccatgattgtaagtttcctgaggcctccccagccatgcatagctgtgagtcaattaaacctctttcctttataaattacacagtcttgggtatttctttataggagcatgagaatggactaatatacccgtcttgatcattgggattcctctgtgtacggcaaagcacctagtgaatgaatgatttatgaatgatgggttattattaacacacaaagctatttttgtctcaataattttgcatacctttgaactgagactcagaaaaaaatgttttcatgaataagaatagataagagggacattagagcatggactgttgcttatacttgaccatgaacaccgagacagtgccttcccaacacctagcactattccaggtataagatatatggcctgtaaatgacttctggtttggactggactggactgaactggactggactggattggattggattggacaaggatgcagaaagaaactgaccataagtctgctcagaaaacattcaacctctaagagggagggaagtctaccctcccccacctcatttttatcctaagcactgcctggaggaaatgccctccaagtcccatggtggaaaccatctaagatgccccttcgtccatggggcttgctctttattttaaatacagttcagttttgattgctgaaattttcttggagccaagggattccaacaatgctactactcagaacatcaagaaattccctggagattcccaaagtaaataatgtgatataactcttacctacaattaatctatgcatgaaaatatattgagggatatgacatcttctaaaattacctgcctgaatttctagcagagagacctagggagttacatcatatgctgcctctccaaacccaacctctgaatgacctccacgaagggataacataataatgcggctgtgtcttggtaaatgtcatttattccctcatgaattttgacagagatgacatcaagtttcttccaattctaagatttgatggcaccataaatatgacttcaatttttaacaatttaatgaaaaaatccttctggaaagagctgctcatggggaaacacacctcaggcatgaggcacattttcttttccagcccttcctccaaccataacagatccaaaatggacttccaggaggatcctgaaatgagcccatgtgttcagcctctcccttaaccacatggaaagggcaggcggatgacctgcccaaggttgggaattcttcacacactaaagtccatcactgacatttaggagaacattttgtttaataaatgcaaaatgttctttaaaattatatccatgctttcattgtcaagggtcttaatggatgtgtttaaagcataaataaatatagtaggcattctgcttgcttaacctttcttcctcaccccttcatctcttcatataacattcactgaacataaaacaggacaagtcctgaactcatttctattccaagtactaactcaagtcactggaaaggtttctatttcatttagatggtacagagatgtcctgctgtttctgtaccatccccatcccattgttgatatttgatatgtcatgttcatatctgttgtctttgtttcccaaagggtttgtttagagtccactgctgaagaagaactaaatggaatctgtctctgggcaggaaggtagggaaggcctttgttttcccccacagtggcaccgacccagacaacagatgacagaaggaagagaccacaggcaggacaaggccagcctggagcagcacctggcaggacgaggcttaaaagaatgaataaggggtaggcccaagcccacacgtgtcatggagtaccatttacaactttgcccacttgacaatgggaatggggagagcagagccttccagaccatcaacagtaggatcagaaagtagaagagtctggaaaagcaagactaagccagaataatctggaagaatgcagccccagtgagaagttgacagccaagcaaggagcaagaccatcctgttaagaggcactgagtggtgaaaacagccttgtcatgaaacagggcagatgatcatctcggaacgaacaggtgcattcaggaaagataaaaatgaaaacaggaagatcaggatcattaaccggtaaaacaatgcatgcccctaaaataacaactgacaaggataaagtggcacagagtgagaatcacaaagtaacgtggagcagattgactctaatagaccttttctggccccaaaagcaaaaggtttggttggtgacatcttaagacaccttaactataaggtccctaagtggacaagagcaggcaagctctctcatttggcggggaggttgggggggaacaactttaaaacagaacttaacaaaatggctaatactaactccttgagaataggattcttctagagaaaggcaatggtttgtaggtaatgtagccattctgtcaatagcatcagcaacagcactgcctcctttacaacacagacctctcagcatcaccctctgtggggcaggagacagagtgagcagaggttagtcacatccatgtgggttctagctcccctctaccactcactagcagtgtgacattgctcaagtgacaactttgtgcctctgtttcatcaactatcaaatgagaataaaattagacttacccaccagggttgctaggaaaactaagcgttaaagggcagaacccaatcctgaaaatttagcaagtactcaataagtcaaagttagtccctggataaggacctgaaacatgaagtagatgcaattcaaccagggtcatgcaaagccgggttcagtgggaagaccactgagtctgtcagacacctcacattaagccaacagtcattgtgacctaccaccatccacttccctgacttctccaagatggtgtcaatgacacactctacctgtagaccgacttccttccccatgctccagccagtccagatactaagctgaatgtacttcagagcttcagcttcataagtcaatggagtctagaattacagcccacacacctggtatccagagagccagagaagagccttgggcacatatttctccaagacatgggatgtgtttctctgagacatttcctcatcctcctcctctctattcctcttgctccctcccctcatcctcctcctctctattcctcttactccctcccctgtctcttccctcctgctcccccatttaatctcactgtgatcctagcctgcttcactctctggccttgcagctaattaaaactgtggcccttagtcatttatttaaagaccccaaaaaaatggcacaggagatctagcaatcataaaagcatcacttttctgagattctaacagggatagctcaggaggccctacacaatgtattggtgaatctattctatttcagcctaccttgcctgacactgtttatagggccagaatttattaccagccttacggcttcataaattagctagtcagctattgccacacctcagtatactgtcacatctgtgaatttatggcattgtggcttaatgtagcatcattgtcatcactttccagtacctggagcattcattttatcctggaagataattcgtcatggttattatgagaataccaacataaacaaaagaggaagaaaacatgtaggttatggtctaattgcctgaatcaatcccagaagaaaagaagatacttgacaaagtctgcagtctttgaatgaatcttgaatgtgcttagtattattcagactcgaaatgctttgcacacttgaatgggaaagtatgcagtgaaaatcccattgaaacgccacagaacgccagccaagctaaagtgctgcacttggttggaatatctgggctctgactcctccgtaaatcaacatttaaagtgttagatacagagagtccataaatcattattgcatttcttcagcataagctagtgccttcagcaagtgtcttctgctgtttggctctttgttctgatctggtttgatatggctggtgtgggtttggtttggttcgtttgtggggatgaagaggttatgcaacagaaaggcgatgacttattcttttgctcttgctcacatctcccaggacgtaaaaacaatgccaattcaaccctcctactcatgtatgacggccaaacctgacttctggcttctaactgcaaaatccccagcacactctgcaggcccgcagccagctcgtctgcttaggaaggagcaatagtgtaatttgaacatgaccaataaaaaagaacaatggtcttacttacttttacaggttacattgtctcacaggtaaggaatggaatttttaatacatttaaaaatagagattcctaaccaataaaatatccccatcaccaagattttaaggatgccatgagtagctggtattatcaatgacatttgtgtagtgggaaaagcatggattttggagaaagaaagatgcaggcctaaacgtggactctatcattcactattgcccaaggacaggctttctctccaccaggctaaatcaagtttcccagtacacaagtgtggtggggagcagagtggttccgcagcagcaggctggtaaatttagtcctaaaacaagacaggtctaaaaatcttggaaagtagaatctgtttggaagctccttctagacattctgtcaagcacagccttgttcagtaagaaggaccttagacatactttactcatggcttcccagaaaaaaagtgaaggatgatgccatcagttttcagcatttattgagagaactcgaactactggaggatttcaaagatgcttattgggtatccaagtaagacgtcaagtaaaattttggatacaggaatttgagtgtgaagggaagcccaggaatgcaactatctgggagtcatcggtgtaggtgggattggaagccatgggatgggatgagatcacttaggaagcaacagactacccccttctgtgataaataaattccagcagattagtgtagattattgtccccaactcttatgtcctacctcctttcatgcagctccacatgtcatcttgtgacttgtgcttgcctggcagtagagagcgcactttcctctccaggaaccttgggcttggccaggtgtcttgctttgaccagtaaaagtgagcaaaagtgaaagtgtgtccgttccaggtggcaacttgaagaggaatcatgcatttctgcttgccccttgccatctccccgctgccatgagagcagcatgcctcagagagctgctgtcccttcaacctgggacccagaataaaagacacagggacctccattaggcccagctgagtccgacagagctccagggacctgaagtcctctgagtgacaaacaagtggttgctgttacaaattactgagacttttggaggccatcatttgctactgcagcaaaagctgactaatacaaaaataaaacccatctcttctggcagatccccccagaaaggagggttagtctccctcatagatatcaggccaccaagcctaagagagttccagatggctatgcaagttcagcccaaggcaatatacaaaaatgctccgagtttaccactggaatttccagagtctacttagatgctcccctgagtccccactcatgcctttccagcaatgaaaacctgctccgaagaaaaaatggctgacatcgagatgactctgagtacacaaggtgcgaagttacaggagacagaggctctctcggatctccaggtaaacacacgcagctgctcaggaaggcagcctgatccaggagcctgcaggagcctgagtcctacccagatggtcaggtgcagccccagctgtcccaggacatgcacgggaggaaaggtgaccacgtgctgtcagatagcagctcaggcaccactgtgcagtgcacaaccacacaggccttcattcagcaggggactagatttgtactctttttagccaaatgtgggccttctcatgctccacgtgtaaacgtaactcaccaaacagggcccctgctgctttccgggccaagtcagtggagaggactgaaggccggctcacagctaggaaagcagggctctgccgcgccgagggaatgggtcccaggtctctttcaacatcagtaggtaacacacacactcacagcacacaccacacaccacacacactacatgctcatacatatcacacacacacacacaccccccacacatgacatacacaccacaccatacacatacatgccacacacacatgctcatacataccacacacaccacacacacaccacacatcacatacacaccataccacgcacatacacaccacgcacacatgctcatatgtaccacacacaccacacacaatcacacacacacgtcacatacacaccatatcacacacatacacatcacacgtcacatacacaccacacattacatacacaccataccacacacatacacaccacacacaccacatgctcataaataccacaccacacacaccacatgctcatacataccacacacaccacacacacatcacatacacaccataccacaaacacacacaatcacatatacaccacacatacacaccatgtgctcatacattccacacacccacaccacacatactacatgatcatatataccacacacaccatacatacaccacatgctcagccataccacaccacacacacacacacacacacacatcagcacacacacacgtcacacacattttacatacacaccacacacacacaaagcatgcacacaccacacacaccacatacacacaagaccacacacacacatcatacataaaccccacatacacaccacacacattatatatgcaccatacactcacacgcacatcatgcacacacaccacacacatcacatatacatgccacacacacacacattacatacacactaaatacacaccacatgctcataaataacacacatcacacacacacagacaccatgcatacacaccacagagcacacacataacccacacacatcacatactcaacactccacccacacaccacacaccacatacgcaccacacacacacacacacacacactgcacacacaatacacatacacataaaatttgcatgaaataaacataaaggaaatgaacaccaagattcatctctcttgccctgcatattggattgaaacatggagcagactggccaaatttaagatttttataatttacctctgaaatcttcatcaaattcaaaacacaatttcactttttgccccatccggcagtgttgggggttttgccactggaataacacagtatattttccagtcacaccgtacatcagagctcatgtgtgtgttagtttgttgcaggcgtcctggtagcagagcgtgaggtcctagactcagagtgagttcctccctccagaaatgaaacacctaagttgctcagcactgacagcaaacatgtaagtaaggcaaaggttgccaccagcccagcaggggtcgaacttaaaatgaatctgtgcatgtgggccccttgcctttgacccatggggagcatcattccataaataaacaaggcaatacctaacagccattagatttcttcaaggccatctctgcaatttctttgatgaaacaaaattgaagttcataatttcctcccaagctaatgttttacaataatttttttaaagatcccagagttacagtaatcacatatcaaataagaacattcctgagatgttttccatttggaatagtgaaattatttattaaagcatctcggccttcatccttcaggctatatgtgaagccttcaagaaaacctcctcgtgagcctaaccacatgacttggcagcccccactcctactttctagatcatccctggccatgctccaccacccatcccatgatccagcctcggcaaagccctggctgtctccacattacaccaagcacctggctgcatgctctggcatacgccacttaaactctcctccctgggaacatcacatactggggcctgtcgggggtgggtgggggacaaggggagggagagcattaggacaaatacctaatgcatgcagggcttaaaaccgagatgacggggtgataggtacagcaaaccaccatggcacatgtatacctatgtaacaaacctgcacattctgcacatgcatcccagaacttaaagtaaaacaaaaaataaaaaaactctcctccctactcatcccggcgaactcctgcctgccccttagacacagttcatgcaccagctctgctgggagacaccccttctgtggtctccatagagctcctgtccacctccgttcacagcgtagggctgggaaaaaggttctgtgatgggacgacctggatttgaatctcagcaccgctcactggctatatgaccttggacacttaaccttcctgtatctcaatgttcttgtctgtaaaactgggataatataagcactcacttgaggcaaatgtggtagggaatagatattttaataaatgtaaagcacctagaataatacttgaaacatcacagcccttatcacaatgtattaaagttttctgtttatgtggctatctcccccactagactataagcattttaaaaagaatatgccttattattttaatatccccagtatttagcaaataacctggcacatagaaaattttttgttcagaatgttgaatgaatgaataaatgtatgaaattaaaaatatatattaatattaaattcctgctatcctgtcccaaaagacaatgtgctgtcatcactgcttgaggaagaagtacattatttcacacatcaacccaccttcatcctttgagaatttttttttagagcagaaatagactctatccaaaccatatggcataaagctgtagtttttaaagataaaggtacacttcaaaaaagtgctgactcatttcatccttagatacagaatactcatcttcagcattacaggcttgtgatggaagaatacaaaattttaaaaatatataaattcacctcttagaggtaaaggtttgaagaacagagttatttggtctacttgcaccattagtttgtttttttttaattttactttaaattttgggatacatgtgcagaacacgcaggtttgttaaacaggtattcattgtaccattagtttttaagaatccttgatctttaaaatgctacccacttggcctcctcttttattcatggccttgttctccaggagagaggctgaaacatcccttagggaacattttctgtcaaggtgctagaccaggagtgtgaagcagcgagccttaaattgcaggaagccacaacagcagaaggcagaacgctcctcaaacttgaacgcagagcctggtgctgcttccaggaagtcccaagccagcctgacttctgacagttgatctcaagatctcaacctatattcattttcacatcaagactttatttttgaacaggttccaggatacaacaccagcttttttattgaaggcaaagcattctcaattacttagatacttactaattaatatgattggcgatatggtgcgtatttagaataatctgagatgaaactcattgaagcagctttaaaaagcccattacaataaaaataatacttgaagctctttttttttttttttttttttttttgagaccaagcctcactctgttgcccaggctggagtgcagtggcgtgatctcggctcactacaacctctgcctcccagttcaagcgattctcctgcctcaaactcctgagtagctgggcctacaggcgcctgctaccatttccagctaatttttgtatttttagtagagacagggtttcactatgttggccaggctggtctcaaactcctgacctcaggtgatccagtcaccttggtctcccaaagtgctgggattacaggcgtgagccacgtttggccaacactcacttttcccaaaatgtcatgataataatattcagtgtggaaggactgaattctgagtcacctgcaaaccatgatacagtctgtagcagtggtactgagtgtaatccatagaccagtgccattttgcaaaatgttgactgaccatgatgagagaagtacggaaagtaagaagggcttgtaaaattttagagcaagttgacatcactgtgacatcagtatgagctcagtgctccagttcctctaaataaggtgccgaccacttcagacactgcagcattactcacatttgggcactcattggtagggccacattacaacatgtgaccttttaaggtcagtttgtcaaggataaatcaaattatatgaaaatctgagaaaagggaagcacttattttcataacttattttcataatctgagaaaagggaagcacgttatgaaaataattaaaatttaattaattaaatgtttatggctttttaaaatttatagtttaacattactggctaaataagggaagtcaaattagtattatgtatttataacctttattgattgattgatggcctctttttggtcagaaaaacatatatcttttttgaatgtgacaatcacagtaaccaaatgatgacaaagaagttgacattgaagaaatgaaagccaaaaaattttgtattcattttacttgaaagtataatccctcatatacaaatttttatagtttatgtagccataaactacagttttgcagccataattgatagcaaagtgctaaaaacactgtaggtcacttgaacaaatgtattggcaaacaaaacaatgaaactatcaaaacttgagtagcatttacataaaaaaattttttaaataccgagaataaaaaaaaatttgcaaaaaagagtattattaaaaagacaacaaaagtagatgttgaatatttcatgtctaaaaatgaatgtcttaaggcttcctgtaaagcagcacttacattactaaaaccaaaaacaaacaaaatgaacaatcaaacaaaaatcataaaattgccaagacattaatgtaaaactacattaaagaagtctacttggaaatgttcggtgaatctgtaacccaaaaaaaggaagcttgagtaccactttttaataatatcacaaatcagtgtttttaagaatgggctgatagcatagctgtaatgacaggaaaatactgtgaaatcattattcagataacaatgaaaataaatcaacaacctgcttcttttcttcagaaagtcttgccaggaggaaaaaaaaaatcagctgaacaacatgcttagagacatagtatataaaaactaatgcattaaattcaaggtttttacatttattatgtgatattatagaagatgaacataaagaaccgtagaagcatgcaaggcttgatggctgttatggggaaagattctgacaagaatgtttgaaatgggaaatgaactcttagcgttctggtaggaaacgagttttgtcccatgtttttaaagatgtgaattagacagccagactttcttatctgtctgacatcctcagtatttgaaaatatcttaatactcctatgcaagaaagggatgtggtaattttttgatgtatatctttatataaccatgcatagaagagtctgggaatatacaaaacaaaataataagagtggctaactctggagagaaatgacaaggagttttctcttcttttttttttttttgtgaaacagggttttgctctgtcatccaggttggagtctggagtgcagtggtgtgatcttggctcactgcagccccaacctcctgggctcatgcacacctcccacctcagcctcctgagtagctggggctacaggtgcatgccaccacagctggctaattgttgtatatttttgtagagacagggttttgcgatgttgcccaggctagtctcaaattcctgagctcacagaatccactcgcctcagcctctcagagtgctggaatcagaggtgtgagccaccatacacagcctgctttttctttcttttgcttctctgtatttatagttgtttttctaccctgaatgctgcctatgtcattagaaacaaagaccacagagtcataaaagggtcacacaagttcaaccatttaaaaaacattgtcaagagctttgcccatctaagggaccacatgagcattaatgactgatgggctccatacactacccagaatgactaacacatcaatgaaagacatgatgatctaaggaccgagggaggggtcgatctaaaacacaaaatgtccctgctcaatagccacctgcacacccacagctactgcgtggagaaaagagagagctggctgcagtccccctcctgggggaaactgtgaagcacaacagagacctgctgtctggaacctggtggctccctccccacagtgagcataccacacctgcactctcatgcccccacttctctcatggaacttccctgtcccttccctccagaagctacaagctctcagaatcacacctttcgtgctccagagtcaacaaggctgagtttgtggtgggcaacaaacagactaaatcttcacaccatttctcattaaaccatccctgttcatgagatctgcattaaaacttttttctcttttgtcaagagataaagcagcagtacacagctttagaggactagggcctccccagtaaccctttcctccaaacctttctaaacaaattatcattatcattggtgccgttatcagtatactagtactgttaaagccaagagatgacctgttttaggcaataacatttacaattcaatagcagagtttcctgcacagactgtactatttacagagtcctgcagcccctggacaagggaacacaggctcccagctgcctgcttgcagagttcccctgtgggaggcagtgagatggaaacacctggatgagaggccaggagacataagctcctccatccctggttctttctccagggaagtaaactaaggcagattgcccattctctctgctcctaaaccagaggcaattttaagtggcttccagcattgatacactaggtctctatgaaaggtgcaaacctttccacactcaatggattctcatcacaaccaaagcagcagggcagtgtattagttaaaatccattttagttgcaagtgacagaagataacattgattttttaaaaacaatggtggcttaaaaacaaacaacccaactcaaaaatgggcaaaggacatgaacagacatttctccaaagaccattctatggccaatgagcacatagaaaaatactcaacatcaatgagataccacttcacactcatgaggatggccagtagaaaaaaaatatatcaagtgttgttgaggatatggagaaattggaacccttgttccatgctggtgggagcatgaaatagtacagctgctgtggaaaacagtatgacagttcttaaaagattaaatatagaattaccatgtgatccagcaattatacttctgggtatatacacaaaagaatcaaaagcaggaattcacacagatacttgtacatcaatgttcataacagtattaatcacaataaacaaaatgtggaaacaacctattcatgatcaacagatgaacaggtaaacaaaatgtagtctatacatacacgggcatattactcagccttaaaaaagaaatgaaattataatccatgttacaaaatggatggcccttgaaaacattatgcaaagtgaagtaagtcagtcacaaaagaacaaatatcatatgactccacttacatgagctacctagattaggtaagttcacagggacagaaaggagaatccaggttaccaggggctatggaaagggggaagggggaattagtgttcaacaggtaaagagttttttgggggatgatgatttttaaagttctggaaatgatgtggtgatgcttgtacaatattgcaaatgtgctcgatacccctgaattatattcttaaaaatagataaatgataaaatttatattatgtatgttttaccacagtagatttcttgttaataatggtggcttaaaccataggaaaacaagcagataggcctggtatgattatcagggacccaggttccatccattcagccacctcaacacagggcttcctctttatgatccaacatggctgctccaactccagtcatcatctcagccatgcaacagggaggtgggaggaggaaggacaagggcactcctctacctggaagttcaaccttcccttgagggatactttctggaagtggcacacagtccttccattctattggtcagaacttggtcacatagttgcacatggcttcaagggaagctgggcaatgttgactttgttctgggcacccatcttttcagctaacattgaggaagaagagacaaacaagtactgaaaacaacaaccaatcctgcataagttgaaaatcaccttgagtgcaaatgttttttagcacaggactgcacacctttatgttttcctaggatcacagtcaaaaagaagaagctttaagaaatggttctgaggactttcttctttgttaagctcactttgcaacataagaggaattcagacctcatagggatgtgagctacatagttattcaccatataccctcaggaagaagtagagctaaactgagaagcactacaaagaaaaaataaatgaagaagaacaaaaatgaagataaagggtcactttcttaatgcctcatcctatgcattttgtagaatttgaaacccctggaatggaaagcataaagctctgacaatctgggctgcattcagccttggcagaaaccaggatgtgaccactggctcattcctaatgtttcaggtgggtaacaaatatttgctttttccggggagttgaccacacaccctcttccaattccttcaactcggactgcatcttgcccttgagaaaaaagatttggcaccttcagaacacaccattccccacacttcatttcccattaaggttgtcttggttaaaaatgttgcgggccaagtacatggtttcacatactcacatggttaagagagagaataggagttctatgagtcacagaaaatttggttgaaaaaaaaaggaatcaggaagaatcagtaacactaaacgcccacacgtctcgtctctttaaagcacattgggggaaattttgcttttagtggtaactgaacattctgttgctgctatatatgtcattttcagcagagatgaaataactaacagcctgggaagatttttatagccttcccgtcctttaagggatggcgtggtcccaattttgacctcccttttactactttcctttcctttggataaaatccatgtaatcctctgtaacactagaacatctctgcattactgtgtgcacacctgatttccgtaccgttttcacccctcattttggcagcaatctatgcataaaggcaaaaagttcccacacccctatcctgacctcttggtagccgtgaccctcatcccagctcaaccctcctggcatctcctctctcctgccaggtttgtggctcaagtcaggaagcacgtcagccctgagacctgcaaaccgaatcccacagacagttctagagggtgtgcttgactttggaaacccagtttaactggcttctgcttgaatcatcactccattaacatcatcattccagaaagtcgttgctcaaggtctaaagcacttgaaaccttcccttatatttaatatttattacccatcttgaaggaacggcatctgaggacatcctcccatcttgtaacatggctcccctaagaagggtataacatagtgattgcaaagcaggactctgtagccaaccatccagatgcaaattctgattccatcacttcgcctgaatataactttggataagctgactaacctttctttgcctctacattcttatctataaaatgggcacagtaaaagtgcatcctcattaaaaaaatggtctacaagcatatgaaaagatgctcaatgtcactaatcatcagaaaaatgcagattgaaaacacaaagagatgtcacctcacacccattaggatgaacactataattttttaaaaattaaaaacaagtgttggtcaggatgtagaggaggtagaacccttatgcactgttgatgggtgatagggtttggatctgtgtctccacccaagtctcaccttgaattgtaataatccccacgtgttgtggagggacccagtgggaggtaattgaatcatgagagcaggtctttcctgtgttgttctcgtgatagtgaataagtctcacgagatttgatagttttataaaggggagttcccctgcacatgctctctctctctcgcctgctgccatgtaagatgtgactttcctcctcctttgccttccaccatgattgtgaggcctccccagccatgtggaaccatgagtcaattaaacctctttcctttataaattacccagtcttgagtatgtctttattggcagcataaaaacagactaatacagtgggattgtaaaatggtgtagcccctctggaaaacagtatggagggtcctcaaaaattaaaaccagaaatgctgtgtggtccagaaatcccacttccgtgtccatatatccaaactaactgagatagatatttgcatacccacattcttggaaggactaatcacaatagccaagaagtagaagcaacccaaatgtccatggatggatgaataaatgaaatttagaatatacataccatggaatattattcagccttaaaaagtaagaaagtcctgtcccatgttacaacatgaatgaaccttgaggacattaagctaagaaataagccagccacaaaaaaaagataaatatggtatgattctagttatataatgtatctaagggagtgaaattcatggaaacagaaaatagaatgggttaccacaggctggagaaagtagggagaggggagttattgtttgctgagtgtagagtttcagatttgcaagatggaaaatttcttcagttttgtttcagaacaatgtgaaaatacttaacactactgaactctacacttaaatatgattaagatggtaactttcatgttatgcatttctttttaccataatagaaaaaaaatcatttaaaaagtgattcttcatagagcttttgtatggattatatcagttcatgtgtgtaaagcatacaacactggatggcacgagcgagcatttctcaaatgtcatcgttatcaacgaattcacataccctgctccatgctatatcagcacacatgaattattttatgtttggttgggtgcctttttatttgtttgtatggagttttgttttcttatttatttttgccttctcaattttctgtgttttctgaggcctgttttagaagctttacacatctattttttaattattccttaccaggatgaaaataaaaagtagaaaataaatgtctgagaaaaccatcatctgcatctccttcaatttcataagatacaatttgaagtgccgaattatttcatttgttttgggttttaaaggtccttctttttactgaatgagagggatgtagattggcagcagttgatatgaaaaaaaaaaaaatcaggttgtttccaaaggcagtgtgatgggctgccctaaagctgctgcctcaaaagaaccataaggttcagatcacaaaatataatggtctcagatttcctagggcctgttctgtatataattctctaagaagaacattgataaaaaataatacgtccacaaaaataaaaccaatatgataactctaaaatacatattgtaggaaatcaggttaaaataagtagttgtattttatctgcaaaagagaagtttaaggaaatactgctttgaaataaatgaagataagtcaaatattcattcatttattcagttctgaaattattcagccactattcactgtaagatttctaggtaccattctaggtgttcctagtccccattatgagcaaaagtcgccacttcactgtgttattcgaggagggaaaagtagatacgatgatggaggcatatttgaggtcgatatgagaaagttcacgctcacaaacacagctgtgcataacgggaatggctattttatgagggagtaagttccctgtccctgggaatatgcaggaggagaaaatgtgagcattaagaatgccaagaagaaacttctaactagaccccaaatatctggtgtagataacaatcaacctctcctccaaccaaaaactcttcgagtccagttttaaggcacatcaagtggagagaacatctgtattctcagggtgacttcaggacagaatgctaagaaaatcttcactactgacttccatgttgcctgcacgaagacccaatattccattgtttttaacacagacctataatgaatctgtaacacttattctattaaaaatagtcagctccctttgcatggatgcagattgatgatccatttttagaatctcaataatgattacaatggcacagcatgtcacctggaaggtatactgtagaatccttgcctacagggtttcactgaagctttgaaaagaacatgaagataactgctaaaacttggaagcaaccaaggttccttatataggtgaatggataaacaaagtgtggcacatcaagacaatggaatattatttagcaatgaaaggaaatgagccgccaaaccacgaaaaaacacggaggaatcctgagtgcatattgctaagggaaaagtcaatatgaaaagcctacatactatatgactccaactacatgatattctagaaaaggagacagtaaaaagatcagtggtttctatgggttagtgaggaggaagagaaggatgaatagggagagcccggggcatttttagggcagtgaaacttttccatatggtactatcatagtaggatctgtttttaacatagacccatactgaatcctttctgaaaaatgtgagcctactataatagtatagcctactgtaatagtaggctcacatttgtcaaaacccataaaacatacaacaccaagagcaggccctaatgtaaactatagactttaggtgataatgatgtgccaacctagatttatcaattgtaacaaatataacacactaaaaagcaaaaacaatcaaactactctgagataccaaaaaacaccagatatatgcataaataaagaaatagtgagtaattcgataaatgaaaaagtaaccaagaggaaacttcacaggcatgattcctttaaggaaacaaagaaataagcataataataataaacttctcatttctaaaatccaaaaactgttacaaaaggattcaatgtgatatttttaaagcacaattattgagcataaaatacaatctggaaggcatataactttgcaataaccttttctgtgtttaggtaaggttgactgcagagttgagagctgggccattgacatttgaggtcatggtggcagcagtccgccactattaccacctatgtccaaacatagctgaccctagcatgactcaggttgaataatattcaggaaatgaggccttgggctagggtcccagctcttgcaatcactagttccacaatttgggggaggtgattcttctaggtctctattttcccatacaagatgatatggtttggctgtgtccccatccaaatctcatattgaattgtagttcccataatctccatgtgtcatgggagggaccagggcaggtaactgaatcatgggggtggtaccctcttgctgttctcaagatagtgagtgagttctcatgagatctaatgattttatctggggcttttccccctattgatcagcatttctccttcctgctgccatgtgaagaaggacatgtttgcttccccttctgccatgattgaaagtttcctgaggcctccccagccatgttggaactgtgagtcaattaaacgtctttccttcataaattacccattctcagttatgtacttataggagcctaagaatgaactaatacacaataaatgcacagaagaggtcagctagcagttttcacacccgtctccaggagaagagaagctaggaggagcaggagggcaaggagggtccggctcccaccaaaagagttcaccctctgggggaagggctacttattgggcttttatgcaaaattttatttgaacaaagaattcctcagctttaaaaatagtggcatctggttccttttccctgaaggtatttactcaagccaaggaatgaagcacctgtgggtgaagagcagatgaaagctggaactataaaagccggagggaagctttttctcatttctaaggagattatcaggaagaatgtactctggcccctggaaacccatccaacctctcctctcccacctgggctggctgcagcagctctgcaggatgtcacccaaaaagctccgttcccaaccctgcggcccacagcctgacaggaaaaagaactctctcaacctggattccggggccctgtactctaatagagggctggacactgcctggctgtccccctgcttagaaggaagcaaatgtttattcaaaaatatttattaggtaatacaacaaactgtcaaaaaggaagaggcgaacactgttacagtttacaaacatgaaccatggattcttaacaaatgggagactttaaatggggatggaaataaagccccaaggaggggaaagatgttgtggaaatgctgcccagtgggaggcaggcttggaaccgcacgctggtctggctggtgataatctagtctagatgaagatctggacagcatccttctgctcagccactagcctctctttgctttctagtcagtgtaaaaagcatctcaaaaccattgctttcccagacttcagtctcctgaaatgtgtgtgtgtgtgtgcatcccatatgtgtgtcattttgtgtttctgccagcctttctgttgaaacttgccagagaaaatgacccacctgcgaattggcaaacggaacctgactgaataaaaactccttgattcagagcttaagaaacaatccagtggatttcttactaatctgggtgttcaaaatagtctttctacttacttgggctcaatattttggaagctattgtggtgaaatgagtgatcacgttggaattagacactgtactactaattgtgtgtccttggaaagttacctaacatttctgagcttccatttcctcaacataaaatgaggataaaaatgtccatcatgcaagattgtcctgacaactgtgctactgtctacaggatcctaagaaagagcaactaaaattatgttaatgttattaattataattttaatcatcaatactgttaataataataaaagactttaaaataatttcctcgtttttaacttactgtaatatcaactgtctgtggtagcctgttcacttgctttgtccttagtcttgtgatccatgtctttttcttatctgttagttttatgctgtctcttcacaagttctttttctgcgtgtgtgtgtgtgtgtgtgtacacatgtgtatgtatgcaagtgtgtgttccaacaggggttcccacttgcccattagaagtttatgctggggtctagataataaaagtaagaaatccaggactacacaaatgttaactgagtggattgaagagcaagagagttctcatcacagccaaacctatgagcacaatgcattgggcatatcagagaaaacgaagatctaaggtaaggtgtgaaacacagcacatgcaactcgaaatgctgaggggaagatctggtaggggggcctggtttgtgaaactcctccgatctgggtgcgccagtccgggtgcaatgtccagctcagccacttgtccccatgggaccttgagcaagtcactccatgattccatgcctcaggttcctgctctgtgagttgggaataacagagcccctcccagtgggttgttgtgaggatttggggagttaatccaggtaaagcccagcacagtcggcattctataagcgtgagcttcatcatgatcatcttatcactttgcgtgcatctggccctcctcacttacaactactgcaccccgtggtagaatgcagcactcatccaacaagacttgcaactcacttcatctctaaaatgtaacaggtccaggtaaaaaagggcagattgaacttgtgggcttacctctagaataatatcactaaaagtagaaattcaaatggacaaagggaagaaagaagagacaacagcctgtggaagatgtttgcaaaatttggaagatggaaagcaaataagagaatggcagttgatgagtgaggggacctccctgccagaggatggggggagtcagtaaagggaaaggcaatttgcaacatacgaccctgagagctttggaaatttgaggtcactcagagggtgggagcagggcaaggaatggggctgaaaacatgagagtgtatgagtgttggagaaaggggaaattcaagtgctccctcctcctcccacatcccctttctgatcccctgcagccaggtaaccatcctgtgcctagcaggtaatttagggttcctctccagagagaaatcagggactccaggctctgcagagtgagggaatgaggcaacatactgaaaagggggaccaagtgaatggcaaggtacctcccccaggatcttccctctacttcaccctcagaaccctgcagccaggctctaacaaccccaccctcattccaccaccctttccacagctgacaacagcagtattctcccccaggagatgctgaccaacccaagagaaagagctacttagacagtcacttatgggtccccaatgacatagtcaggtgctgatacccatcacggcacacacccccagccaacaagccccacctgggcacacagtttcctagtgaattattctgaattatttcctagtgaagagcatccaaggtccaccagacacttgtgaaaaacttccaagcattagaaatgatgaccaaaatctaacaatcacgaagaaaaaatgtggagcaaaaagagatgttttaactttaaaaaaaaaaactatcattaagatcctaaagataagaacaaataatacagccattaaaaaaacagttaaagatgccttgaataaaaaggatcagagaggaggttcaacatctaaataacaagagttccaagaagagaaaacatttaaaaatggaagagaaaattctcaaagaaatcatacagaaaaatttcccacaactgaagaggcccactgagtaccccacataataaaaggaagaagaccctaaacaaggcacatctctgtgacatttcaggacactgagatgaaagagaaaaacctaaaacattcagagaagagaaatgggaaccaggatggcatcccaagcttcttgataacaacaataagagctggtagtctatgaagcatcactttcactttccaaatcgtgagggaaatgtttcttaaagggaatcaaaggcccagccaagccatcaatgtgaagaactacaccaaccatgaggctgacaggataacctggagacaggggacccagcatgaaaaccaacagaatcctagggtgccagagggcagagatgccaggacagccacgcctggaaacagccggttccatctgtgagcacagggctccttaaagcaccctcccccacaacaaaacaataaaaaccctgagagatgaccaaattcattctaacacactgaaaagaggaactggttctgccaaggagtttaagggagtcttattgtaagtacttagaaaaaccaaggcaataaaaaaatcattgaaaatcaatgaaaaatcaattgaaaatcattgaaaatcaatgaaaaatcaattgaaaatcaatgaaaagttattgtttttgaaaaaatcgaacattacagcacactatatgactcagttctaagtaacatttacatagttataataatgttacaaatgcatatcaacttaaccaacattatgatttacctacattggaaggatggagaaacaggagatgggggaagggggcatgagctaaattctcatctaccttaggagaaaattgataatgtctgatatggtttgcctgtgtctccacccaaatctcatcttaaattgtagctcccgtaacttcaacgtgttgtgggagggagccggtgggagatgattgagtcatggggtggtgtctcccacactgttcttgtggcagtgaataagtctcacaagatctgatggttttatgaggggaaacccctttcacttggctctgatctgtcttgcctgccgccatgtaagatgtgcctttcaccttctgccatgattgtgaggcctccccagccacgtggaactgtgagtccactaagcctctttttctttataaactacccagtctcaggtacatctttatcagcggtgtgaaaatggactaatacaaagtccaaatgaaaagctcatgaaaacgcagtgatgtatcaacaaggaggtaaatgacagaagaaacagctaagaggacagcagttacctctaggaaagggggctctctgggaaaatggaaggcagagaactgctatttttcattataagcgcagaaatactatttgacttttacaactatgtattagcatgagaaatataacaactagaatagaacagtgataaaacatgtagaaaatttcacagtgaataaactaacgcatacatagataggcaaccgttttctgagagtcagttgtgaacccagaaaaggcataaaatccagttcttcagagccatcccatgctcattgcatgtaccaccagtttgcttcctcccaaaattcacatgttgaaatcctaaccctcaaggtaatggcattaggagctggggggcctttgggaggtgattaggtgttgaggatggacccttcatgaatgggatcaatgcccttataaaagggaccagagagagctcccttcaccccttctaccatttgaggacacagcaagaagatgccatctatgaaccagaaaatgggccctcaacagacaacaaacctgccagtgccttgacattgaacttcccagcctccagaactatgtgaaataaagtcttgtttatgaccatccagtgtacagtattttgttatagcagcctgaatgaaccaagacactcatcatcagggctgttgcatctgccccttcccaccacagtctcactaaagcaaccggaaagaggcaccaaatacgtccccctttgttatgttagtaacacagtcatgttataatacaaaataaactaagcaatgtcaaacagatcaacataattatttagtatgacataaacctcttccaaatgcacatgcaaattttttcattatttaccttttaaaagccttaaagcttaaagtgaaaattagtgtgaaaaaaaaaacaaatttctgaaaggtaatttgtcagtctatatcaaaagattaaagatacatatctttcatcacacaattccactttcaagagcgtatctcagtctgataaactacagcatggtttgaaacagtaattttcatcttggaggcatgtgagaatactgattcctgggccccaccccaagacagcctgattcaattggcctgggataggacctgggcatctgcattctgcactcaagattgggaattcctggtttataatatagaaaactagaaacagcctgaatactcaacagaagaggactaggtagataaatttataatgacagagacatacgatggaatactagacagtttaaaagtaatgtggcattaaaaatatcattaagcatacctatgaacatgggcagatacttctaatgtgctggtaagtgaacaaaacaggtgccagcacatatatataaaagtgtatatataatatgatcccctttggggaaaaacatgtgtataagagagaaattccactatctggaatgaaatgcattacttttcaatagccattatgtctgagtgcagaaagatttaatttaaatacttttgttcatctgtatgctcacggtaaacaaagtattattgacaccatcttctaaagttcaaaaatgctgttatatatcacttgtaagttttaaacattttagtactgttcatatagatttcacctcacaccccaccctaaatccatatacacagacccactcaaactctcacctgcagattctcagagcacactacatcctgccaagtctccagcgtgaagaacaacttttgcataggtttcatctttcctttgtattaataggtaacaaagtctggctgcctcaaactcagaacatccttgcaacactgttacacccactgatcttccaagttcaccttcacaaatgtgcaagggatgagggggacaaagaccaagtcaccagcaccactcctgatcccccagattccagcccaggtaaaccattcagcatcattggtcaaaggtattgggtcactgaaggaggagaggggtagaaacaaggcattgattcaaatacttccaaaatatgtatgtgttttcccaagcagctgttactccccagcttgaggaaagtgctgagttacagatgatggagtatgaaacactgagagagggcacaccctgtgccttcgcagcaagaatggcagagctacagtggctttggtgttttacttcacccacttttatgcctactcttttcttagcgcccccttcccttactcattgcatcaaagtgatccactgaaaagaattaagtcaactgcagagttccagatagctatcctcaggagttttaaaacttaagatgaaagcagtcagggaattaagactaaatcccgaatatgtaagaaaagggctttcccacgtggcacaatacacgtactgtctgcttcacaggtccagcctggtagcaatcaggcaggataccagagcacgcaggaaatccaaaattaggttttactacctataatggaagatttacgggatggtttaattggtagtctcaggactaaaacctgaagcaggggaacaaaaacgtctatctggacacagccagtgagcccacgtgcaccccatgacactcgctcataggacacacaggcccgaggctgcaggggacagagtaaggtcacaactcctccttctcccaaccttgatgcacaccaaagccaacaacatgctatttcctgttccttttatttaagaggcaaatttgtttcttgtggtagaatgggtcttcaagctacacacacaaactcaggtgttccgcaaaacaaaagaactcattcaattcagtcctcccctgtatttccaaaccacaggggcaacactcacaagctgcaaagaggattccgccccaccgggaatgcatcggtctgcacctgtctgttgccattttcagggttagcagggccactggaaaatttcctcagtaccattttgggtcaatgtaaaggataattgaagtgcatgtttctgtaaattccacgtgctcagagagatttcaagtaaacacaggaaaataagaactgtgggcttgagccatatgttggctggccacgtggggcaggaagaacacacactgtccaggcagtgagtaactgaaaaccaagtgcccacagacaccatccactgccagaacttgggaagctggggtcccaagggacagtcccctctgctcaccctctcccctcctttctttctcaccctctcaacaaactttagtggagttggctttttttcctagaggccttcatagccactttttcccctctccaggtggtagcctgggacctactgtgcagaaggacacacaggtctgaattgaggtcaagccaggaagaggaagaagtgcagagcagggcagccactggcttctgaaatccaatggaagaggcggcaccatttagtagcatgacattctgtctgcaaaccaccatgatgatattgttactaagtagaagaatcccttttaaaagaactttcgatatattataacatactataacaagatgggaagacattttccttttaataaattgattttcttaaaggagatttcaactttccagtgatggacacttttcctggcttccacttgttttctgaaggtttccatttgggtgtgatttcttagcaaacaagagccttcccaaacattgcctgcagacatcttggtctgtagaaacaccttataaggagatcaacgtataacacagtctttttctacctagagaattagcaaagggtgaaatttggtatgacaggggtcttccctggattcctttcaatgtagtccaaggaagaactaacttaggctgaattctattaagacaaggttatcacaatatttacaagattatttatcaggattatatcaattaaatattttgggggaaaaaattgccatacaaaaatcatattaaaattgagccaagcagtgaaacaactctgaaatggcctagaaataacatgtatttgatattcactttttctgaatacagatgtgatcttcatgccatcattgaccccaggtggtaaggatcattaatgtttctagaatcctacactgggcagctgatgcctgtaatcctagcattttgaggggccaaggagggagcatctcttgagcccaggagttagagagcagcctgggcaacacagcgagaccccatctctacaaaaatattttaaaacttagccgggcatggcagcatgcacttgtagtcccagctacttgggaggctgatgtgggaggatcatttgagtgtgggagatggaggctgcagtgagctgtggtcacaccactacactccagcctcagtgacagaatgagactctgtctcagaaaaaaataaacgattttaaaaattttaaacccttaaaaataagtaaataataaattcctacactgttgtacagttaacggccccaattactaagctcaaagggaattacccagaaaaggcaagaaaaacctaagtgtgaactatggctatagagaaacaaatatatggcttgtaatataaataggtttcatatacataagagtgtaggcatacattgcaatgtatcatctcatctgaccctgctaccaaataaaccacaatgtgattttgctactgtggaatccactgtgaaacgagtcatatttcaaagaggtatttttagtgatttttaagggcaagaattcacagacttcagatctgggttccacgtgaccatgacaagcacttggtcagttctgcggcttgggctccaaattcaatgtgtggatcaccactgactcaaactaactctatctgtaagatgattcaaaagagacaatttggaaaaacagaagggaggaaagacttgagaaagagtgagcttttacaactaaacagtatttgcttgaatttaaacaccacttaaaacatagacaacaaagacaaaaagcatcagtgaaaatgtatgtcccttttacattccaaatacaggcccagaaagcaataagcaaaaggcacagctgggctctgtatagccgacttgttgatgtttaatgcaggtaccactctgatctcagcccccagatagaagcatatactctagtgatggcccaggaagacgtcgaccagcacaaagcatcaccacacttcccacattctgagttggatgcaaccattctcttagaaacctagtcttgactgggtgtggtggctcacgcctgtaatcccaacactctgagaggccaaggagggcggatcacttgaggtcaggagttcgagaccagcctagccaacaggacgaaaccctgtctctactaaaaatattaaaaaatcagctgggtatggtgaaatgcacctgtaatcccacctacttgggagactgcggcacaagaattgcttgaacccggaagatggaggctgcagtgagcaaagatggcaccactgcactccagcctgggtgacagagggagtctctgtctaaaaaaaaaaaaaaaaaagcaaaacaaacaaaaacaaaacagtcgcttctgcactcatggtaacatcctttaccatttaatctctcctagaagacagggcattgccataccattactcacttgaagatgagaagtggaggatttgttaggactgcaggtgatgaggagagactcaaacagaatgttagattctgaccgatctgctctggtttcacacacttctttcccttcctaagaatctgcttttcccttcatgtactttttcctgttttcagtatcactgggtcatttctagtaactctgcttaagtgatcctgtcagctacagggcgtgggtgggttattcagctctgcctcacagaacactcaccctccatctctgagtcagttgccttttaatggaaatactattcgctgatcatgttcataccggcccagttttgtttctcttgacaatggcccaggtgtttttctcttctgattgagttttggggtaagctcagcatctttgttgttgttgtttgttttattacatttccatttttactggaggggaaagatcagagtcaatgtgatccagctgctgcacgtcagtcccgccacatgacctgcactgttacatccaaagcgtgcagggaaaaggctgcgtgctcaggtccagaagttcataaaggcagcctctcccatcagctcaccggtggctgccagcctccatgccgccttgctctctctaggctactggtttttgcaaccttctgcttttgtccactcataactttgataagtaccgtgtcaccttctcatacgtggaaaacatgtggtcagcgattcggcatgtttaatggtgcttgaacaatacaaaggggagctgtcatccatcttttgttttctcattatcagttttcaggccacgttctaaacaaggacgacaaccaacagaacatcattccctggtgtcccagtccttgcttactttgaatctcctcaccaccttcagtcctttctaaggtcacgtacgggcatccaccgtcttttttcctaaacagaatactttgcaaagtcaagtattggcatttcgtatttaagccatgcatcctcaaggaggctaaaattagttcttgaaggatgaaaaacgtcttattccttttctgtataaagcacagatatacctaaatgtagacatacgtatatgtataatgcaaagtactaaaacagtatatctgtggtattaaattttcatgtgaggagggacaattaggaaaaaaaatcagaaaatgctttttaggaggttgatcatgaaaacaggaggttggtcatgaaaaaaaaggttgaaaaacactaatttaagcctaaatgtaactacattacaaaatgtcactacttcttgctggttttggcaccagtgcctcaggtgacacagaaatactaagttttcttttattctgatatgcttaaggtatccccaaaatgatttctctaagttgggaattgaaagggttatgttacactcattcactctttaacaagtcacatacacgtcacctcctattttagaagccaatgggtattaaagcacaagaaataaaaccactgaaaaagcaaaaaataaaaaggaaagaaataaagactcggcactctgacacagatgaagcagatgattatgtttatttaaaacagcaacttattttttaatgtctatgaactaaagatttctcaggacatcttatttcatgttaagtgtccaatgcagcaatctttgccttgcaaagcccattacaaataggcttgtgcattccagaaaggaagcatgcatttaactttcccaaatatgtaatatgcaattcttttttttaaattttttacttgcttggagcaaagactgaaagcaagtatttaatctcgcttcctttgccagtgcaaacgtaactaattctgatcctcatttccatttcttccttaatctttttaaatcagggttgggccagcatttattcccaaccttttggagaagtagcctgtatttcaaatggggccgcgatgctaccgcatgttgtcctgaccagtgccgtcctgatccttgctggagaaagaaatggaggcattttactcacaatcacagagcttacgtatgccagcattacagaatgcaaaaaataactttgcaacaatctgaaagggtaatttatggagcgtggacagtaaatggggtatgttttctgtcctgaaaatcccagatgagggcaggcttatgaataattttcaaaaatcaggaagtctgtggaaatccctactgtcttataaagattgcaccgtgctcatcgcatctcccacggcctctgcctcctcctccacctcctccgaggttccttggtcctgactcctaatggcaagggccaaagaacacaggcacctgcctccagcaaatccactccgattccccctcattcccagacacaaatttccatgaaaaccagacagaggacagaaagcaggggcaggatattccaaaagcacttcagatctgcagcctgatttcattggactcgctggcttgtttcttttagtccctgggtgtgttgactgcaggagaaacctcactaacgacgacacttcagaactgtgagtccaaacacttaaggaaggacgtgcccaggaggaaggtctagaagctcagagacagtgaggaaggggcattgctcagcgatgcttagatgccttcatgagctgactctactgggagtcacttgtcatgcccctgaatccacccacacatctctataacatatgaaaactgttcagcccaaaggaaaaaataaactcgatggttctcattaatccaagtttaactaaacacaacagtttccaagagtacatttcagccatttcgcacccgcagatacccaacctgagaagctgatgggaaacggctgttttggcatcaccgagggctgcggcaggcagcacccagggggcttctgtctcccctgtggcgctgcagctgagagccacacccatgagctgatgacgtagcgtttctctcaaaggtctcccttgatgatgtggcaaactgcaaggaccaagcacagaggcacctggacaccaacccttccctgcgagccacatggccagtcaaacgttctggttaccggggatgacacgctttttccgacaagattttaagcacttgtggcttacatcaatgtggtctcgtattcattgtgtgtttagaccacttgcctcgcacgttctcatatttacacatgttcactgaacgtaacctcaagtgaattatttaagaagccttaatgtgcttcagactgctcaaatataatttagactttaaattaaatttgtactctgatacgaaactgcaatgcttgaatgcagcttacggcatcaagtggacatgcaggaggccttggaatagaatttcagttacccctaaagggctcacacctagtggcccacgttccttataggacgaaacaagattcaactacaaaatccaactcattgcctacgtttgaaagctggggagcctgcagtacacaagataaagtcttgcttctccatttgtccttacgtgaccctacaatgaagcatcgctacacaccagagacgtataatgctagacgcgagaacacacagtcatgctccttggtcagaggttttgggtatggttgggtgttttaataaaccacaatattccttctccttcactgtttggttaccaataattgtgctgccttaggtgtaaaattcaatatggtgattagagtctagagaagccacacttattttatttagcagtttttgttttatttttacagtaagcactgcccactgggaaaaataaaccaaaataaaaagagtgaaattcccttattatgcactagcgataatgaaaacaaacttatctacaaagaaccacagacgagaaatttgcctagagaccagctactggaactaaaaacaaatttcttattcaggaaaatgtgaatgagtaagaatctgctagtgaagtttcttactttgcacaaaaaattaaatgaaatcttaactttaagagtagcataggctgggcacggtggctcagcctgtaatcccaacactttgggaggctgaggcaggaggactgcctgaactcatgagttccagaccagcctgggcaacatggcgaaaccctgtctctactaacaatacaaaaaattagccgggtatggtggtgtgcacctgtagtccctgctactcaggaggctgaagcacaagaatcgcttgaacccaggaggcggacgttgcagtgagccaagatcgcaccactgcactccagcctgcgcaacagagcaagactctgtctcaagaaataaaaattaaaaaaaaaagagtggcatagttaaaagggtagaaggttactcaatgacgcatcacgtatagtacacatatagcacactgataataacaaatggcatgtaagcactgtggattgacttcagaagacttttccataagcttcagtatcacaaacgaagggaaaagcctgtgttatgtgcaacctgtcatgatcaaatagtgtgaatatgtccttgtaaaggttaattctatagcaatacatttagttgatgtgctttcttcctctgggattctagcactttaagaatgccgttcttcaaaataatcaattgtattattctcaagaaacatgcaaaataagaaatttgtcatcaagctggaattatctttaaatagaggatattcaaatagcatttttatgcctggagttgtcgcagcatgattccggcaaaagccgcactatttgttagctggcacacagagttttggcctgaaattcagtattttattttaccctttaaaagcatgaagtgactcaacaggaaattatacatacatttttccctccaatgtaaaaactgcagatctagtaccgaacatgtcacgctggcattcaattttctattgctatcatatctggttccttagtgacataaggtcacaaaacttctactcctgtggccaagagacataatagatgttgcggttgctcattatattaaatttgaattcctaagctaaacattctagacctgcactattcggcatggtggccactagccacatgtgactatggagcccttgaaatgtgaccagcccagatggagacgtgctgtaaatatacactacacaatggattttgaagatttcatatagaaaaaaaataaagtcaaatatctcatccatattttacactgattacatttgaaatggtagtattttcagcatgtgttacataaattacattattaaaattaattccacctgtccctgtcttttttaatttggctactggaagatttaaaactacccttgaagttcatgttctatttcctttgcccagcactgccaggaccttacacggactctgcctccacgtcactcgctcccttccggtcacttccataacaggcccgccactctgaccaagataactacacacagcagagtcccatgggtggatctcagcatccgcctgcctggttctgatgctgccctggttcccactactgtgtgactccaggcaaggtgctcagcactcctgagcctcactgctattctggaaaatgaggacaattagagcacctcctgcaaagagccacagtgaagacagtcctggcaaagtgtctcctgtggctataccatctggtgagtgaatgtcacctgccaccttccacaacatcacacctctcccttcccttatgtaagactgctttcttccctacctcttaactttacacctgagatattgaagtaggtgtctggtctgatccctccaacactccagaggatttggtcagtttccacactgtgtgacccactcccaggtaacacttccaccctccaaacacaccagcaggcctgactcctccaccctcccgcccactgctatctctaccattcccgccaatccagatccaacacgccatggcacagctcaagggcctcagcctccgggtagcatgctctgatcctctgatcttcctatggaatggtgtagattgcttttggattgcatgattctattttatgttatttatactctaccttgttcccaaaaagggactcaaagtggtctacaaggatatatgcaatatgacaaggttgtttaaaattcagaagcaaaataaaaaataaagatgaagctaaagagaaacaagggtaagaacataaactcgagctaggaatgcaatggcccgccaggcaggcctcagggtctcacatatctgctggagttgggtcattcacacgtctccaaataatgaaatccaaccaaatgctcagacaatgactcctgatgctaaggctaaaaatgaaatcctccaatgattccataagaaagaaggacctgtgtgatagcaagcatgcccaagaacggccctacagcaaacccagtgtattgcacgaggctgtctccctgctcgggaacatctcctccattgccatacagtctagagccctgttcactgccatgctggcccagttcaaccaggtggtcccactgaggatgccactcttgttggtgtgtgaactcatctccttcgagatttcatgatgtgcacattcacccccgttctagatttcatgacacaagcattcaccccttttctagattctatggcaagtatgttcacccactttccagattgcacggcattcgcattcaccgcctagattctagattccacggcatgcacattcgcccactttctagattccacgatgtgaatgttcccctcctttctagactctgtggtgtgaatgtctgccccaattccatggcattcttgctcacctccctttctagattccatagcatgcggattcatcctctttctggattttgcctccctgaaggcactgtgcaagtcttctgcatagtgtcttgcatgaagtcttacacagaacataaggcaaaaacatggactaaatggacagcttgccttccaccacacagtctgtagcttctagcctcccttcctttgcacgtgcctttcccaggatccggagcaccccctctgtggatggagtcctgtatcttctcaccttgagtcaaatctgactgcccgctgatctctgcctactcagcattccctgaattctcaggcattccacttgtcctgtattaatttccacctgtaggtatttatcctaaggacaccgcatttagagtgtccttgcaagaggggatgctcctctcttcagctaaacttagctatttaaagtaaaaagggtggtagttttgtttacctgttaacacaactcatggaagagagaaaaattcaagcatgccactaattgctgcagtcagacagacaggtggataggcgggctccatagcggaatgttctggcttctcccactaaatttgcagttgttcgtctaatctctagacgtgtcccgtgtcttaacagtccctgtatgacttatgctcccacctcttgtttgggacagtgctctcatttaatagatgctcaatatattttaattaagaaatgtattttcacgttgcttaagacccataaagaacaattaatacaatgtaatgcttaattttgcaaagaaaaagtttatattgatgctaaatgcatttacaaatgtgctcgtaatgtacaaacaaatacagcccttactgtgggttacacatacttatgaaatgattttattgacttacctttggttttacaatttggctatggggtacttagaagaaactgcccttgtgggacattctgtctaatcacttatatttacaagccttagaaaactgtaaaaatatattcagtttcattaagagatattcgatcttcagaactgatactatttcatctataaaatccttttactggctgggcgcagtggctcacgcctgtaatcccagcactttggaaggacgaggcgggcagatcacctgaggtcaggagtttgagaccagcctggccaatgtggcgaaatcctgtctctactacaaaaattacccaggcctgttggcaggtgcctgtaatcccagctactcgggaggctgaggcaggagaatcatttgcacccaggcggtggaggctgcagtgagccaagaatgtgccattgcactccagcctgggcaacagagcaaggctccatctctaaataaataaatacataaataaaatccttttactttgatacctcaagtagtaatcaataatatccctctctgttctaatggcagggcctttaggtaaggtttcagaatttgggataaatactaataatatgctgatctaacatctcttctccagaagactccctagatttgatttttactgtcattatttctattttaaaactctgtagtgaagtaagttttactgtcggggtcaaatagactagaaagtacttttcaatactgaagaagcaaatttttcctccacttttgcttattctgtcctcttgctgctgtatcttgaactgcagaaaaagcaagccttgcacaaggcaagtttaaactttgtgcaattatagacccagatttgtaaatctggcagcaggctcacatcagctttgtgaggttgggtataattttaatgagaatccattcaacatatgaaatcttagaatgtttctcaattagcacttggtttcttttcaaaatgtttttacctcatttcctaataaaagaaatctcagctttctgatacatttaattaaaaagttttatgttgagattgtaaatgtgagtggtttctgtttcaaaacatttcattttgctagtacatccttcacttattatttatactctgcttagatctctgcatttcccatgcaaaaatcctgaaatgcaccttcttcagtgctgaggtctaaagtttccccttcctaagtagtgccacagtcaccccctcttcctcccacagggccctcataatagcttctttcagtccttcctctgaaccctgagacccccgttcactctcatgtcaagcagaattccaagccttcattgcacacagaggtgggtccagggaggtatcccgtgtttctgaaattcctgctttgcctgtgcctaagcttcccaattctcccaagagtcctcattttaagaacacaatgcaatgctagcattgcactagcattcagcatctcccaccatacattgcaaatggataattagcttgattgctaggagattcacctgctatcccctcttctcaccctttagcaatgtgtgtggaacgcacttggctccgaacaaattaattgtgtgtgaggggtgacatctgactacgaacaactaaaaagaaccatttaatcaggccaaattcccttcaggcttattgaggcttgagtgtggatttttaaaatgtaagcagcactgtcactgtaaccatgaaactgtcatggttttaagaagtgaagttttgggggacaacaacatgaccaacagactctacctcagcatccagttcccagattagttaatacaaacttgggccccacttttcaacagaagcacagctctaagtaaaggctggtacccagctctgccccctcaaattatttggtgaacaggccaaatgggaggaattgcaggtagtactgcagaatctgcctgccttggaaaacaggctttccatgaaatacagttttaaggtccccagaggccagggctctctccctcccctactcttcaccgcgccccccgccaacccacacgtgatgagaaaccactgcccctgcagaggccccagcagcaggcaagggtctgtggaagaaagagaggaatattacaaaggggtttctggctggaggggggttccagggagggcagagaggttcaggctccaaagctggcagcagcccctacagatggaaagctccagtgacaggacccatgaaaggacactgcagagcttgtcccatgtcattgggccatcgagacatcaagggctgcctggatttcaggaactcacatctgtagaccaagaaggaacagcacgttcccattgccaatttcaatcaatttattaaactaaggcaataggtaagtaacagatttactaagatattgggattctcttactgtccatcttagttcagatggagattcacaacaccagctaatctgattccaggatgcagcttctgacggtgcacaagctaatatttccttaagatagtcacacaaacctccctgccaggcgtgcagaaaaatgtgcacgctccaatttagtctttcttttactttccaactttaagtactttagtgagccccaagaatgcatagccactctttccacccagttagagagaaaattaatctttctaccaataacagagaatcacttaatggaaataggacgatagtacttcactaaataaggcttcgctcctttgctcccctactctcaaaactgaggttcaaatgcatttctacactttcaaatgaacatgtgggaacttttgctgaatgctgacatcaagtgaaaataagggtttcctattttttaaaagtcattctatatatgcctgttttctttcctatttcctagagagacagcttttcccccccgagtatgttttgcaggggtaataattactgcaataatgttatccttaaaagggagcacatataagacaaaagcaggtacaaaaatctcattcccactaaaacaattcaaaatcataggttaggctttaaaaggaagcaactacaaatctaggttttaaaaacctttagacacactaaagatttgtcccagatcacatctgatgtctatttctctgggataataacaaaaaaaaagaggtgataaattaattcaaatggcctattttacatacttgaaggatatttccattgtctcatatagccattctgaataggacagagtcacataatgaaacttcctttgcacattctcctgaacacgcactgagtcaagatagccaaaccccttactttcattgtaaaattactgtttctcatacgcaatcagggtctcccagattatgacatgcgaccctaaaaataggagaacttaaaagttagtttaaatctaaaacttagatccagcgctccatttttagatgcaccctttaatttcttggttttgtctacattttacttatacttaaatttagcaaagtaattttagctcaccctccttcactaccttcactagactttgcaatgttacaaacatgaagcattcaagcctctttctaatatgaaaatgttttaaataaaagataaagttaaaagggaaagatgccccttttaactttaacttttaacttttttagctatgttgaagaactggtttgggtgacagcccagccattggaaaagccattggaaaactcccgctgttgtttatttacaaaataactgctttcaatcaatcattgtgagaggtccgtacactgacaatgcataatggacaactaattaactgacccctaataagagtgtgggaaataccagggagaatgctatcatgcaaggaacagcaacaatatggaggggtggctggtcactgccaagcatgagcatccccaaataccgcagtgattttcagagttttcaaaaagccctactcacaccactgccactaagtaccataatcatcggaaactgtgccccaaagatctgaacgtccctgttacatcagcctatttttcttacaaatgttgctgctaaggttcaaattcaaggtgtagaacattaaacaatagctgtattgtgaaggaccatgctccctgggaaagcccaagtaaccttacacactggggaaggaaaaaagaactcctttgccatactcctgctctctggaaaactgctcagacgcaaggggtaaagaagcaaagaggtgacaaaaagagacctgcattcagagagatcagctgtcaacttaaactgagaagtgacctgatgcctcacagagctgggattttgccaccttgaccaaactgcttcccaggctccataagtctcattagaaacgtaggtggctctgtgtcgacaccttctcaatggagttctatgaaataacaggcatcagacatttattcactatgacaatgtcttcccaccactccagatcctatgaccgggactgacttgctatcggtttttgcctgggaataggaaacgattccagaaacattagctcttctgttttgagaagaaataaattcccccttttatttcttttttgtttaaagatagcaagataaaaataaaaactaatattacttttagaaaaaaaaagtgttgaaagtttcctattaccctacttacaatgtgagatgcatttaaaagatacataacgtataacattgtagaatagtatgtgagttacacattccttctgacgtctttcagagatgctttccttcttacttatgtatctggtattccattgggatcttaggtcttaccacaaataaaatatctgattttataagattaaaaactcaacaaggtttttctttaatataaaagcaaaacgtggaacgtggaggggggaatgtttatatacaggtgtgaatgcagcccctcacacaatcccttcaatggtaaatgctaattttctaaattttagctaaagattaaatcaccaataattcctcatgaaataacagataaacgtgaaatcatgtactacaattctactctaaatttttttaaatagaatgaagtaattataaaatgttacaaaagagaagaaactggaattataagtgctactggaattatatattccttaacaaatatcttgagacggattacccatttgctaattcagtgtactttccaaaagccattgacccaaaccgaagctaggattaccaaatggcaaatagcatttgtgatgtgtgtagctcttctaaagcctttcttgagaattgtaaaacttgatatattagccacaagtttacatagctcaccgtttctgctagaattataatttcaatggtgtaattagcttattaataatttgacacatggtgaattaatttacatggttgggttcttcgcaacgtctgttgcctgatcctcctgtggatgaaggctatgagctctggcctgccccgggagcgggcaccagccaatgccagcggagcaagggttaactttgggactgtgacagttctcccttcaggggctctaaactacttggagagaatggaaaacagtcaaaaatagtcccaaaggtaaataaactctgtgtcctatgtatgtcacccagggaagaataaaatgtatttttactcacattgaaagttttctgaactacaaaagctatagagacatgtacagagtgaaacctgtagcacatacgaatatgttattttgaaagataaaggaaactatctttagattaacgatgagttgtattaaatccacatcctcattgaaattgtttatccattttattgcgcagtgtagtctgctattaataacagaatttgtcctgtacttaaaagataattaatgcctctatgcatctatgcaacataccatagcaataaacggacgatgtatttcagacagaaaccaggtaaggctagctgataaaatacagactatattttttttaacatgccaagttttgcaattagggtggtaaactggaggcaaataaacttaacagctgcaggctgaagaatggaaaggtgaaaagactgagactgagagtgggaaaggaaagggaccgctcctggcgctgagagctggtcccagagccggtgttgcggggtgtgcgggaaggcgccgtcgggggtcattccaccatcaggacccagcggacagtgacaacccagcctcaaacctggtccctactttaggccaagcgtcagcttttttagttcaaccctgatttccactccagacaaggacaaataacctcttggtcggggccccagatgaagtccccgcggtgtgctctcctggcccttgtcaatttcggggtgccccctcctctccatccgcacccgactgcacgcgcctccctgggaccccgcactggcgagccgtccctcccggcgctggacgccccacctgtcccggcgccgtcggaagagccctgcagagtgagcccctagggccaccccgctgccttcctccccgtccccgcagccgctgtagccagcgtgggagccgggcaggtcgcgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccgagccgggtcgcactaactccctcggcgccgacgggctcagcccatggtgtgggcgccgggttcagggaggctccggctcccgccaatcgcggagcagggcggccgccccgacgcgcgacttgcgaacccggagtgcgcgccgggggcggggcagggacgcgtgggcgggaatgcacgcgcgtggccaggtgcgcgtgggtgcgagcgcgcgggagtcttcgagtgcgcgcgtgtccgtgtgcgcgtgggtgtgggtgtgctcgcgtgtccgtgcgcgcgccctcggggccaagagcgcgggccgcgcgggcaggtttggacactacgcgccctgctcgggtttaggacgcggctggcggctccgggaggaagaggaggaggaagaggaggaggcggaggaggaggaagaggaggagggaggcggaggagcagaggctgggacggccggaggagagagtccggccccagcaggaaaggaacccagcacgcgactactggaggggcgaggagcaagggaaggaccagaggggaggagagggggtcaggggagggaaagtgtgggagggggagccgcgggggtgcgcgctcctcctaactcggggtcgcttttagcgagaagtgatatttttccagcctcattgaaaaccgttgcaaacattgaaaatagtaaaagtgaaaacggttgcgacactaagacgtttataaaatgaccgcggactgccctcgatgctgatgagaactgggacgacgtcgcgcagagcgtccggagggagaggcgcggtgcccgggacctcggtcgtggggaggagccggatacagccgccgggacgcggggatgccgagggcaccgcggcctggtctgaccgacgcacgcggtgacagccgcccttgggagacgacggcgtctgcaaccagcagcctccaaagggtgcagccaggaggctcagcttgtccgcctccggggctcggggctaagccccttccagaagttttcgtttctacgcgaattccgaccgcaaaatccagcttacctgagcgccgctcctcttctctcatgtccctcgggggccgtcacgaccgtcccggagcgatctctaggaacctgtcccgcagcgatctcttgcacactctccccattccgaccaagtgaaaac

SEQ ID NO: 2627 - DNA, 281756 bp, Homo sapiens; identical to SEQ ID NO: 2626

SEQ ID NO: 2628 - DNA, 204921 bp, Homo sapiens
tttggtgtatttttgagtagtccaaagtaatttttattctctaattagtcacctcacgactttatttgaatgaattaatgagaagctaaataaactagctttttaaaaaatattttcttctctttctccaggcaatgggtcactttggggcgctgcagaacatctgtgctttccctgtgccccatcaccttcccagctcctgagctgtagccatctctgctgcacctgctgtcagagggcagctcctccggctcctgctcctgggttgcaggtgccacatctgtgcagaaggcttaggagaagcagtgagccttctaactgcagcagtcctgacaaagcactttgtgaacccctccgggacataagggcatcaaactaggaacaaaaacacagtcttgactgtgatttggtgattttaccacatacaaggcccgaaagccaattgaagacaagaaaagaagacaaatctcttgccagcaggagtaagattgtacaggagtctgagtatacatcagggcaagccaagagacagggacaaacagagagaaaaggttcatgcaattatgaatatgacctggagggggctttggaattagattacaacagtaacagagagttaatgccattttgaaacaatttaagaattatgtatttgaaggaactcagtattatcatgttatccaaaattatcccagttgctcataagacttgctaataacctggactgggggtggagggttgagggatctaatggaaaacatctgttaaaattgaatatgataatcatgtcttgtttttatgatcttgctcatgagacagtcttgaagagagaactgagtgattatccaagtaaatgtgtatttctatgaagaatgtaggtgtgtcttgactttgcattccaaaataaaaatgactgatcttttccattagcacagtttgggtcagcctaactgccagctttcatgattgtatttatttattttccctaaggagatacgggcactttgtgggccttcccaggctgctgcaaaatgatggatggttgggctccgtctaatccaaatgacacggggtgtcaggagcattggtaatcgtgtcctgccgacttcaaagcccactgccaaaacatccacagcacagaggtttggcaacttcacataatcatagcaaaaggactgcaacgtgaaaaaaacaggccctgaaacagctatgaaaagggccagttcagaaacctattcagctaagatgtttcggctagcgccttcgcacggtcaccttgtattttcaccttttgagttgccttcacctggaccaaggttggcagcatttgtgattcaaagaaaagatgcccagggaaactgactctagattatggaaataaacattgtcttcaagggatagccagcaacatcaggctcagggctagtgaatcccaagccacagtgcccaggtaactctgatgtagcaggactaaagctgtctacctagtgagagctcctgaaagagaaaccccgcagcaaatctagacgttatcccttgtttctgtaaagtgagaaattgcagctatccatgacgctttatttgccagtaataatacagtttgccttacgagtggtagcttgttcactgttcaacaaatgtattttaatcatagcaggaattaagggtgatttgtgaccaggtgctgaactagaatttctcaatgacaaccccagcttcataggcctctttccattccaggcataaatatggaggctccaatgtgaaacccggggtccttctgttccaaaaggggctagaaataaaagacaggaggggaggcaagaaggacctggagaggctgacgccatttgggtgccaaacatcctatttccttggctctcccttgcacaagttcctggacaaagtaaattataacacaaaatccacaacattcagcacatgttttcattaagcaactttagtcactaaaaaaagtgcaaatgcagactcctgtataaatctgatttgccatgctaggccaagcttattttattacatacattctgcattctaagaactaataacttcatattgtaaacattaagcatacagagttaaaattcaaggccacattatatcgattgtctcttttgtcgtgtgtctttggctggccgagatcaactcgtagtgtataaatgcataagttatataattattatataaaaagggggaaaaacattgacttgtatacttcattctgacaaacgcacagcgttcgcgactcaaaggaaaactggaggccgcctacccaaaatgcctgcgtgatttctgattgtggcagccaagaaggccatctcttacctgaccctgtggagaacaaagcccccacataatgatgaggtcctgaatgtttctcttaaatatcagacaattccagttaaaattttcatttgacaaacaaagaaagagatgcgcatttttgtttctgaattctactacttcccctttctccattacgctgtgtcctttctcctaacactgggtttggtataacactgactgcatgaaccctcgagtctccataactcattgtacacagtccccaaatgtcctgagtccagtcttcattgcttgagaagtttctttcccagccctggtctcctccttctctgcctcttcctcctccttcttcacccctctgtctacaatcacacgctcactctatacacatcctcagtcccaccttttagttcatagtcccggtaatactgtaaaggagttggaaactttgggtcatcttcacagtttgagaaagctgacagctgtccatcaaacggaatgtatttgatttcaaccaaaacagcacatgccatgcagttgcatatcaacgtctgttgatgggccacagtctctctcgtgtcttttctcttgtttttgatatgtttctatttttaaatacaggtagttttccttaaaatggcattataaacggtatgttaggtcaaaactgtgttgtttctattgctttagtttcatcccagtttgcattagtgggattccaaactctactctaaagtttatacatttcttaagaccactttctttggcactttgtccttaagacttcatgcttctacatacactgtcttttacaaggtcagtccacagatgatatgtccatattcgtgacatttttagcatcctcctcatttctgtagtaagacttcagtaactccctcccaagagtctttggatctcttccccggcttccttccccagccccagtaaagcttttttcattcctcttgaggcacttttgattcatgttctccgatagagtttgtggcgatgggctggtgaatgcacgctgatgggaaaagcctccgccaggtctttagtagtaagtgcccagatgagaaggcatatggctggtggggagcctagtgttggggtatatacccccagttggtgaattccagtatgggtttggggcagcaaaaaaactggaagatgtcacggggagggctggagggtggggcgccacaaagttcatcttctgtgggtgggcgtgataggagcccatgtacgggaggtctgaggggtacttgtacagagatgactccggggggtggggctggagggcctgggcgatcccgtggaagtcgaacttgtaggcgtagcgcttcccatggaccttggtcatgatgttcttgtcatagtagtaacggagggcgcggctgagcttatcgtagttcatgttgggtttgctcttccgctctccccagcgccgggccacctcgtcgggatccgtcatcttgaactccccgttggtgccttcccaggtgatgcagctggagttggagctgtccgacaggagctccaggaggaactgccaaagctggatctggccactgcctaatgaggtcaggagaggaaggaaaactccagtgagcacaggttccaggggaaagaggctctctgtgatgacggaaggaggtgctattggtgtgccgcccacattcccttcaccaggcctgtccgtccatccctcagctgcaggggtgcggactgctctcgttccatggccacccacttctccagagaactgcccttgcctgaacagagccgccgcctcgcccacccccaggtatcccacagctgggtggactgaacggggtaccacgggccggcccccttgcctcaaggaaagaccaactccatgacgctattcaggcttcagggctcccgtgggattgggctgaaacagcgtccagctgcaaggaggcttggaggaggccagaaacttccttagcgctgcccctgcagcacttcccattctctctctcctgagaacatgccgttaatcagtcacctgcacaagcaggcttaccccaagctctgcatcaagggaacccgacctaggacgatgatctaacagattcaagacctagatggaatgcagcgaattcatatggggcaaagttcaggctgcttccatccatttctgacgtccttaaaagaacagccagatcaacctggtgtttaggggatgaaagagctatatatttttttttcctattttgtgaagcacaaagtactgttatgtggatggcaataatgacttaatgccatttatattggctaggtcaagtaagataataaaagttagatttaggaaatgaacttctaaaagtttatggaaaaaaatcgagaatggaagtaaacaccattatttctaacataacattttgctggcgctcagaaagcaattctgtgaaaacttttcctagaacagaattaacccactcaaaatgaggaagtttaggaaaaaaaaaaaaaaagctggctctttttcaaaccagatcacccagttccagtatttgggcaagcgcatcgtaacggaaaccagtgccttgcctgtgtgctgcaacgccaattgtgttaagcagcatttccagaagaaaaaccccaacaatgagtgattgcaagtccccttgggaagctgaatgagactcttcctttgtcaaagagatcacatttagctgggtggacaaagtcagaattttcttgatttcattgaaatcatacagatacagctttgttttatgaaattcaaagaaaaatctaggcacatcattctagctgctatgttacaatacttgaagatagtttatggctccctagaagacagcagcatgtaaatattgacagcagtatccgtaccaagagaagctaagctgtgctgaacatatttcagaagcttaagaacagatgggaggtgggtctttcctcccaaattccagttacagcactgccttagacttattaccaaaagattaccttttattatagtgtaagtaatatcaatcgatgtgataaaatgattaaagtaactttaactgacatctactcagggaagtaatatactgtaaaaatcaattttacgttcattttcttctaaatcctcgctagcctcctgtacatatcacccaacttataaactctgctttgcatgttggctacatggacatggatatttttgtgaatttatccatacaatagcactgtgagaaaggtcagctttttctgaatctatgctggaaagtgctcattttcagtctagcaacacatttgaaatgtattaacagcttgtagctcattgaagtggaagcctttgctttttcagaaccacatatacaaactgttcccaatcaagttttgttgcctccaacattttattaatatgcatttagaaaatacaaagaatggtatgagaaaaccatatggtcttagtatatatattgtaaccaaaaaattacaacttgaaaaaattccgtatatgacctgggaataggaaaaggcatggatttttgatttaacagtctaacagatgcttcaatataaacacatacggttgtttgaaaataaatattcagcgtcaactttctcccatagagaaagcaactccacagacctgccgaaatcacacttggaatctactcaaaccttggcattgcctcttagcaatttgtccctcacccatttctcttataaacgtgtgtaggacagaatcagtggacaaaagtgatctcatgtctctcctatttctgaagagttagaaagcaggggacctaaatttgtggcagcaaactctatgcccaaaggatggatgagctaatttctcacttgactattttacccagtagccataaagacatagggctcaggactgtgagaatttcaagggagggtctatagaaataagagaactgtaagcaaaattcatcagctttcaaaccttgaaagaaacctggaaatgcaaaatcaatgaatgtttaagtaaatggtagaaagagtaacatcatgtcaaactcattaattgttaaatttaatatttgtaacaaaattcgctgcattttgcagtgtgtagaacaaaatttctcactgcaagaattctcaaaaatgaacaatggttgttaaaaaattgtcagtggtaaaggaattattctcagtcataaaattttaagagcaatttttaaattcttattttacttccaaaacaataacatttaatgtgtgacgaggtgcattttagaatatagaatagagatttccaaacaagaatgcttagggtttaggaaagcctaaaagtggcttgggtcactcatgggccaaaccaggatttacaaagagaagttcttgaaagacaagagctttcattgagtagcatcaccacctctaccttaggactcacctttcttgggtaaacccttcagatctattttttttttttactctctcttaataacatccttgcgatgtcagtaaggaggaactaattttttcttagggtaattaccaaaataaaacatatttggaggtaaaaaacagtggcaagcagcattgtccacctacagagaaccctgtgggtgaaagggagcggctgtggcttttaagaagacagaggcactcctttaattttacagaggaaagtaatctcctaatattgttaaaagaaagggagagaaacagggtagcaaaggggtacagactgagcaaaaaagggggaaaaaaaaactaaacggtttacaaaccacagagcaaagcagagagctgcagagtgagtcagcagctgtgtctggtggaaacagcatcctggtgcaaagccctgcagccgtcagctgatgaacaagggcagtaaatacagccgtgaggggccccaccagtaccatgtggcagtggtttggggccactttctctagaagccaggggtggtgcagaagatcccgtgtgcatggcctggaccctctgcaaggcagcaggtgtgtccagcaggtgtgtcctgaatggaagtctctgccccgaggctcagtgaggctcaggcaccacttactggaggggcaggaaagcatggtggtagggagcaccaactttggagttgccactgcttcagctgaatcctgcctctgccctttgtgggacgtttggcaactctcgcagctctctctgcctcagtatcgtcatctgtaaagtgggggtgatggtaatagtactatcttgcaagatcatggtaaggatgaactcagtacttgaatggtcttgtcagaatttctttgggctgaaaatcagagtttaaggaaagataacactcctctcctatagccaggaaatgcctaaagaaagagaaatactgttcaattggcctattgaaccatgaagaagcttgaaacggtgctattcttgggctgactgatatcctctgaaagcttactgtgtgccatgcaccattctaaacgctttacatgtattggtttatttaatccccacaggaatcatgtgattagtccattggagaagtgacgaaattggagcttagagaggtagactgacttattttgcttagcgttggcaagggttgaaatccagactctaggctgccatgcttaatcactgcgcaaacttgctttcaggcctggtttatgcacacctctgtagcctcctcaggtcctttccatgttgtcccctccctgggggactcccactggaagactgcacactgccacctcctaacaaatgggaaaacatccctagcctggtctgtcgttctgcaagaggcaggatgtattttcatgtgcaccattgaagagtatccagttagcatcaaggaagcctctgaacataacccaccaaagctctttcattagaggaaccatgttagatagattctcagctgctctgatgggatgtaaaggagctgtgttgcttataaccgatccatgatatcagaatgcagggacacactgttctcagcaggaaaagtgatgtccaaagtacacatcaagtgaatatttgggatagagatgttgggatgctgacatcatcctgtgcattcatactatatgatgcaatctttccacttaaaatgatgaaaaggaatttgtattgtatgaagagcaaagacagcaatttttaagtgatgaaagatttatttatcagagaatagaaaaatagaatcaaacaggaagaagcattgtcattaatacaaagataaaagacattctggtttcaggggaaaagttcacatgagcacaacagacacaaacctaaagatagatggagagaaagtcaaattcatcagaaactaaatgaaataaatctttatcttaaagtcacttgcctgcaaatcaaagatgggatgttgccattttctccaggcccattaagaacagtcttaatggtatgaagcacagtcctccttccccaggcctgtgatgagtttccggtctccttgctctgagctcaggtccctctatctacaaagggcatccccgggctgctgggcccagggcatatgcagtgttcccttgtgaaagctggcactttgcttaggagcaagtgactcaggccctattctacaaacaagccaagcagtacctttgggctgtgacaacgtggtcatggacatatatgtttcatttggccaatgtgtgagtgcaaaggccagtttggtcttctttggtgcagcttgactctttcctcctcttccttcctgacctcagattcatcgcctgcacctaagcagttatgaccctgaaaggaaatccttgctttctattctcacagtccgcattttgtaagacctcctcttcccttcatacttagtcagtggcagagtagggcaagaaaacaaaagtagactttgcagacagagtcaggtttctaacctgacctcccttatcattggctgtgtgacacaggaaaagttacttaacttctctggacttctaattccttttctgtaggatggagatagtaacctcccagggctgttatgagacacagaagggaccacagacattctatggggggcattctgcgggatgggagctgtttgattgttatttcacatgattgtattaacattcccagagtgtttcagcttccgtcattttcttttttctaatctatcctgaacattgctgccagatcagtcttcctgaagcatgactgataataatcatctcaaaacatagtcattatttttatttgaatggttatatggcagagttgcaaatgaaaagctgagcagaaggctgagaagagaccacagcctcaggagcctgggctactagatgaaagccagcatgagcaaaaagggcctgtggctctgtgtttgggacaatgttgtaactacctgtgtccatctctccacggaccaaaagcaccctgagctaaaggactatatctcattatccttggcattcatgtatgcaacaaataattattgagcacctagtctaggccccaggctaactagttttctttagattttcagctgtgtaaaaaaaattcattgaattcattaacattaaccaaaatttaacttcaaaaatacagatgttcaataatgataacatttcgtgttttcaatgtgtagattctcttgcagggatgtacactgattaaatcttaattattccatttcgaaccttattttggcctcaacgtttaggaaatacacattccatcttgtgcttgcaatatgcctgtaacatcttggcatttgaatttgcagttgggaatatgcagcataggctatgaatttctgaagctggtgccagcacagctggttctgatctgaatacaaacaaataaaactatgtggttggcactgaaacactaggacaggtgacaaaccttggcaatgcactggttacaaatgggctaattaagaatctgcactttcttctagcatcgaagttcagaaacagaccatcgaagatgagcctgaatttgaagtcttgtggttgtatcaaggctctcttttaaaaaatactagttattttatctgcttgtataatgggttgaattgtgttccctcaattccctatgttgaaatcttaacccgcagtatctaagaatgtgaccttttttggagataagatcctaaatgaggtaatcaagttatagtaaggttatggggtaggtattccaacctgaccaatgtccttatgcaaaagaggcatttggacacagagactgacacacacagagagatgatgatgagaagagacacgaggagatgatggctatctgtaagccagggagagcccccaggacagatccctccctcacagccctgagaaggaacgaaacctgccaccatgacactctgatttcagacttccagcctccagaactgcgagacaataaactgttgttgtttaagccacctaatccgtggtactttgttacagcagccctagaaaactattacagcttggattaggttataatgttctttgctgaagctgaaatcttaatttataacccaacccatctttccattaaggcaaataattcagtgagacctaaaactaaaatctgttcagttgaaggaatttctcaccaataccaatttacttttcaaaataaccactgccaaaaagtaattttgtaagaagaaaatcatcagcagtttctcacctggatttgcaaggcggctacttgttggtccaagaatctgataaggatctacagcaaaaagaaacaaagtcaaatcctagacatagttgtaacatagtatgatgtgacttcagacataatgcctgacttaattgttttttcagatttcagagccgaaaatgtcctccaactccaaatcaactgcctccacctcctctatgagagaagatgtcacacggcatctcagatgtcttgctaggggactcctaattggtggcagggcttggattcaaccccaggatcctgacatatagctcaaggctcacaccaaccaatgatataaagagggcaaacatgtgccaagccccatcaatccagggccgtgcaggctgtgttgtttaggcatggaaagtaaaatctaaaaaattaatggatcacaaagaagcagcctgtgtgcacgtagaatttttttccctatttattgcatagttggggacgtgttttagcaccatctcaagtcacctcgcatgagtaggctgatgacttgggccctatcttatgtatggagctgtcgaaaagaggcaaacaatcatgttaatttccattaaaaagtgaagcattttagaaatgtgctgctgagcctgaatcttctcttatggttatccagacggcccctgaaacatacctaactgaggacgctggtcttcagttttgggcactgtggaaggagatggttgagcagctgaaaatccagaaatacaaaaggcaattagctataacagatttggtcactagtctttgatgttgttgcataatcattctatcagttaatttagttattaacataatagtctaactcagaagcatctcacggtaaggaaaaattttcctttctgatgaaatcaaatgtaaacactgtaacaaaaaaagaggacatttccaattatttaaaaaatggatacctcccactttttccaaaagtaaaaaaaaaaaagaatttggaatggcttaccaaacagattacaataaatcatagtctaagataaacacataaagggaaaccaccagtcaaataaagtaaagccagggatacttttaagcatggccaagattcaggaaaacaccgattatttaatgtgtactcaaacatcccatgaaacatgcatttgtgaaggttgacatacactacatcattcctttatttttgttatgaaagtcctgatgacccaaatggagaaagaatcactgcagtgaaagatcaattgtactcttgtcgtcaatggaacaaacccatcacatgttgcaaaatcacagattaaccacagaaattattatatactccatcaacagtcatccactgcctgtgacatgaaactcagggtcatgggagccaacactgtacctttcgactggggcgtggggtggccgtgaccggtccaggctgatctcctggggggctcatatggtaaatctgtaaagacaaataaattgactaaaagatcaatcatgtaatttttataagagatgctttggttttttatttgattttgtatttattagaataaactttgtgcaaaaaaatctggtaatccaaagaaatatcccactagatttgagttttatttacaaattaaaatttcatatattatagtggtctaaaattctcacccgtttgtctgaaaacttccattggcagattctcccagagctttccaactcttctaatttcctacaaccataagtcaagaccccaataaaagtttcttacaatctagttcatcctgcttccactgggactgatctacatctgtctctttattatcttcatgactcatccaaagcagagtctacaacttggatgaaccagcccatttttgtttgaggtctgttcctaaatcaatcaaatgacattcagcttctttttcttcttgcatctcctgggaagtgatcgctgccttatctttttatttgccagctgcctctcttagccaactcccattttccctttataatctcatcaatttatattaaatcagtcttatctgatctagtgattttcataggcaaatgtctcccatttctaatgttctaaataaatttagaatttctctaaaatgacctgcatgaaatgaattacaggactgaaatagtattgctcccacagcccattaatgatgaccttctgagcttaagcatatgccaaacatttctttgtatttataaagtcgtatcacttgtcctataaaccttcatttacttttcatatgcaaatttaataactatacttctgcatcctcagtgtgagttctattaatgattatcaaagctctatgtcatttcaagtttgtttcaaaaatatattacagaaaccttattataatactcttgctaagagtgcatagctaaggctatttctacatgcaatcttattacataactgtttcaaaattatgtcttcttggattgcttggtctcagttcaatgtcatgtgtcattctgggccaagtgaaggccatggccaaatatctcagcaggtactttgctgccagacaccaggagatgtgtacaaaatttcacttggagggtaggacaatgcaattgtttttaagcttctctttaaacaaatattttaattttgtttaaaaccagcaatttgatgggtcaatcttcaaagagcttgactgtgttgcagaagatgtgtctcttcctattttcatatcccaaagagaatagaaatgatgcgcaacgtgaaagtcaacacagaatctccttaatgtatttggtctgtttggctgcaagcatctttgctactagtgtggtctatgaaatcctacccttcagagctttggagaattagataatttttctttttaaactgatgttactcctctctctcagctggcatttttgcatttttggacgtaaatcttttcccacccagatcctcagattttcacatctcttgtgttggggttacacataggaattatatctgcagcccctaacaatttacaactgaacttcaacttaagtctctgggaacactctgcacatgggttctcagtcagttgcattttgtctaaaataaactggacagccagagtttcaatttgcaaattgtctcagaaagaaaaacctactcacaaggcaatcctagccacatctaacctaatttaggagcagaaaagcacattaactaaggccttctatttaccaaatgaaaaaaagcaagataatacagaaatacagaaatatgttctagatctctgtttctcaaagggtggtctgtggaccagcaacatcaacaatacctggtagcttgctagaaatgcagaatcttaccccagacctactgcatcaaaatcagcattttgtttattatctttttttttttttggaggtggagtctcgctctgtcccccaggctggagtgcagtggcgcgatctcggctcactgcaagctccacctcccaggttcacaccattctcctgcctcagcctcctgagtagctgggactacaggtgcctgccaccatgcctggctaatttttcgtatttttagtagagacagggtctcatgctgttagccaggatggtctcgctctcctgaccccgtgatccgcccgcctcagcctcctaaagtgctgggattacaggcgtgagccaccgcgcctggcctcagaatcagcattttaacaagatcctgggtgactctggtgcacactgaagtctgagaaagcctgctctagaccattgctcttttcaggaactctgttcctgcagatgatttcagaaatgctatctagagtgtgcaaagacaaactaaaaaatggttgaaagagttctagatggattgcttttacccatggcataagtatgctaatggaatgaatagacagcatcagtaggttagtcagatactaccttaaacataaaattgttgctcatgaaatgtgactgggaaaaaaaataaatgccgaactactattcccaaaatattttgaaactctttattcacaaaatccttcatatggtgtataaccatatcccatcctccctcgaaaataagtcgaaacttaacaccaaacagtctacttttcagccaagtatttgagacagttatatgaacaatgattcacatgttcataaacatattgccgcggaagataagtgggcttttgttttcttccatgacattctggtccaatgcttccttatcggctaccgatcacatgctgtgggcactaagtatccccctgtgggatatgacattgggaaacattcaactcaggctcactgagatgggggacagccaggggtgacttctttggcagctacaccatctcaaaaccttcgtagttctgctcttgactgcttgaaaaatcactcctctatgtatctttgctatgtgtcctttattgataatagagcatcagacttccaataagaatatattttacatttaattttcgctgatcatttcaacaccctctccatttctctttgactttgatcttcaaggcaatgaactcatatgcttggcagaagtgcccatgtaagggaaggctgctttctggcactggttctgttgttttatctgtaagagactgtgtttaaaaactgagctttatagaagtcattgcataggcagcttgggtgaacacagatgtacattacatcacaacagtataaaaaacagcatgaagctacaaatagggactcggctagtgctgaccactacacaccagcaactgtgtcgatttcctgggagctgggatcagcttctcattctgaatgagactcctcctccaccacacccttttgaagacatcactaaattaatacaacattctggctaccctttcctggagggctaagttcagccaagttttacattctcccttcatcaaactcactgaggaggaacgctctagctcttgccccacacaccccacaccgccaccccgctgcctacccgctttattttttaaagggcaagaatgtggatcgtggaagagctcatcctcattctgcaggatccacaccatatctgcaaagcaactctggaggttccctggctgggctggatgggaacagatgagatttgcctgctcttgaaattagatgctaatggggaacacaaattaggaagagcaagagctgctgctaagaaccaatctagaagtgtctgtgaaatgaaaaaaaaagtttgagtcaaccttaacataattaagttgctctctattttcctccagatcttcttaaaattctacatcaaagtttgagcatggagttttggaaacattttgcattcccttcttgcctaggtttgcatatccctgtggttatataagaactaagcggaagcaaagaatgcaattttagccatttgctaagatacaggctttacataacacctaactgagagatgctatgcagtagttgtattgtctcactatgcctagctgtgctgaaaagcactaggctgtgagctccaatggaggaataatttaagattccaagaaacccctgaagagcagcagcttcaaagtagaagcaaaggctgcatttgcaggcttaactctctaatctcttttgataacaccccagaggcatatcataatatatgggttgtcatggggatggaagaggaaaggatggggttgcagaacatcatccttgggatagaactgagcttttgcatgacctgctcctaagaggacaggcagggtggtgcactgtgtagttaataggggcttgcaagattctgtggatctgtttttgccactttttcccctgagacctcaaagggctatggctccaaaagaagtggattcagcaaaaaagaagggtgtttgtagaggaggtacagaaagggattctggtcgtagtaactgcaacaacgtgagaaacacgtgaaacatcataaaataaagtataataaaatatatatatatttaaaaaatcataaaaccacagaatgtaaaatgatatgcctatgggttgatactttatgagagtagagaagactgtctcaatgctaattcaacaaaggggttgtgaaagaaggtaaatcttgaatcaggaaaacgtgggaaaatactaggtacgggcatgcaaggaaaagggatgaggtttggacaaatggcaggtagtggtggtggcagggcatgttcacatgtggtcccctgtgaggtcagtgaacggcctcggccaattgtgcagggagactgaactgacacagcagcagcgagactgacctgacagggaagcagtcagggggctctggaataaatgatccacttgggaaggtgggccatgaacagaagaaaaggtagattgggggctgggcatggtggttcacgcctgtaatcccagcactttgggaggcagaggtgggcggatcacgaggtcaagagatcaagaccatcctgaccaatatggtgaaaccctatctctactaaaaatacaaaaattagctgggcatgatggcatgcgcctgtagccccagctactcgggaggctgaggcagaagaatcacttgaactcgggaggcagaggttgtggtgagccgagattgcaccactgcacttcagcctggcaacagagtgagactccatctcaaaaaaaaaaaaaaaaaaaaaagaagagaaaagaagataaaagaaaagaaaaggtaggttggggcagtaacccagggatgggtgactcacagtgggaagggaaggagggaagggtggtgaggaagtgctgggaaggtggatgcagcaggacaacacacatgtgtaggagtctctgcagaaagggtgcggaatgctgtctaatttaaccagtaaaccctgaacaccactgtctcctctatcagggactctataatgaaacggccaccatgcagagaagagacagattctggtctaagtagagttgttacctaggagcctggcttgcttcatggtcagcacaataacgctgaccagagttcggttccctcggatgtgggattagacaaagggtatggaaatgaagatcatggcacagcaaaccaagagtggaggagacagggatttgggtctgtatccccaaggaccttcaaagaaacagtcaacaatcacctttctgaaagtagtcaggtacccactgaccacagggatatcgtcagattcccagtgacctccctctggagctcgttcagctctgaaagttagtgatgcaaaagctcttccccctcagccatcacgacgttcattctccagttgcaggttcacagcttttatctccacaggagcagtcctttaaggttgatcgcttagcaatggatgacccgaggtgtataactagttcttatctccaagttcaagtccctgaatagggcctacagtaaatagtcctctggcttgttcagtctgctttaaattctttacaggtcagataccaatatttgtattggttctcataatcacagtagcagtggtcaaaacaggttatttcaggtacaaactgagtcgcgaaaacatacttgactagtagtggagctgtggaagtgtgctctctcccaggtcacgctcaaattatgggcccatggaagaccaccatcagagcggcatgggaggtgtctgagtttgccacccttgccttccctgggttgggcagagagggagtcccaaccaacatcctcacagtcaccctcttctccatccacctggatgggccataccttccaaatccaccatatcctaaaatgtgaaaacaaagcagctccaggacccactgtcttaaccaggtagcatcagtcagctggcttgtctgacagagagattgtgccaatgaatttggccagtgttgtgatcttttaacacagtttataatactagctcacaacccctggctttgcaactcagtcagaggcacctatgagatgtcttaacataaacaaacaaatacaaaattaaaaagtaaaaaaatttttaaaaccctagccaaatgttttggaaatagtttttatttttttagtttatatggaaatattttttaaatgctcacagaattacaaaatctctaaagcttgagtcaaacatgaatttctattttccactcgcaatacacgtggtggatgtctttaggaccaatcttgcagactctaggcactgggtcttgcccatgtttcaatggcctgtgaaatcttttacatgacagagatgacttactacctcttagtaccccttagctgctaagcctttccatcatgcttcccaggagcaagacagtaaactttttctctgacgttagagaagagaaaattgccagcctgaagtcactaggcagtaaccagggcagtgtcagtatttgaacagcctgagaagcttcctcattcattctctttagctccctgggcccccagtctttctcattagaaagaaagagtagttgccaagcctagatcttgaaccagttcgaactgagacttgtgtattccggatatgtgatagagtttaacatgaattctggaagcatgtatgaatatggagaaaccatcccaccaccctgaacacaatgtcatcagctgtgaggctggtacaatgatacctagcttatcgggctgatgtaagtcccagggagaggacaaatgctaaaggcaagctatacccttctgggaaatgccctctctccctgctcattattcgtctggcaaacatctaattcccctttgccatgtggccattcctctggaaagcatctttatgcctttcatgggggattgagttcctccccacccctgctcctacgccctgtattgctagaagtggttcctctaccataaaatctatcacattagggaaaacatttatgtgtacatatgtgtctctctggctctaggtcactctactgaaacatctagaactggaggcaaaacatttcggtttgttcaccatcataccatccgtggctggcacagaggaggcactcagcaaatgaacaaaccaagctgaatgaagaagtaaactttctgaagacaggaagcttactgaagcctggttcatctatatattcccagagtctaacaccacgcttggcactaatgggcacttgatagatgtttatttttgcatgaatggcatgtaaatttattacctaattaaatcatttggaggacaggcagtaagattcagatgtaaatactactggttgcatgcttctgctctgcaagactggcttcttgtgacatactgataatcggtcactgtgaatctggggagtgtccttgttttgtgctcttcccccgaggagggacagatccttctgttagttcaaaagtcggcctattcctaactgccaggcatccaggatgccttctttgcccatctgtctttctgaaaagctagttaaagggctaatctgctcttaattcctttagtgtggtctttgaatgaaatggtttgagtggatttagtctccaaatcaacagaggcagaataagactgtctgggactggcttcagctccgggatcagctctctttgtatcacgtgacttagggcacggatctcagcaggacatctgggatgtctctcaatgaagagatcacacaggggtgttttcgtacctggcctagttgtaattctttgcgtagcttcaggatatactgaagtatttgggaaaataaaagctgcaccccctgcagacaaaaggaaagacaaacatgtgaaggtcttttgttgtggttgtcgatctcaacatcagcgccaaatctacttttccctatgacaacaaagggaagagacctcctcaaacctgccttaacagagctccggagaaacagacaggtgcacctgtcagattctcaagatggaagtgaaacttggagccttggtgtactcctgtgccccgtttgctataaagcgttttgtgttttgattttataacttcttgatgaagccctatctgtgtccccctcaatcccacttcccactgggcaatctcgttttattaaaaaattatatggtacatgttttatttttcaacttgtataaaaacccataatatattttacagagcttttggaaagtagtatcaagcaattataagtatttagcctaagagtatatggattttattaataattaatccacatctctattcaaatgcattttccctctctctcttttgaccaaaactcatgctgttagctgagaaaattcccttttcatagttcagtccatttggaatttgttgtcttgttcattggtttcttccgtgtttaacaatagcaaaatttaatatatttggagcttttttgaaactttcactcaatggttaaagaactcataaataaatgtgaaattatcagaaaatgtgcatagctcaaaggtgtttcctaagaaggggaagtaacttcctctaagttatctgttatttctggccacaaggtcactaataggctgatgtgtgcaaccaaaattattgaaaaagtgtactaccaactcgaagcaggttttttaaaacttcagattaaaaagacaatgtgttgaatatagaagaccatgataaatgagcaatttcattgtaatactcaaaccgggactcactcacattttatattttaaaataaaatggtaaatattgggaaaattgcgtatttctatgtgagggctgatcgtgagttaactggctgacttgcaaggctttctggcacttcccgtctccctccctagcccgagtgattgtggagggtccctgcagctaacagagtggggtgagcagccggtggccatgcttccggaactctctccatcaggaaggagcagatggatgtgaaccaggaacacattcatccacagaaaacccagcctctgctgtgagcggggggcgagggaggaaggttagccaggatgaggcacggtgttaaaccctacttaggctcaggcaaaataaatacataactaagtcaaatgtagaggcaacggttagagatagaaaacaggcatttggttagtgactaatttcatattctccaaaattatagcagaggttccctctgaacaaaagctctcaaaatgttacagaaattccctcctgccttttgcaaacatacaaagtctgtaggaaaacaaatcaaatagcctaaaagtttattggaaaggaaaaagaaaattccaacttatcctagcaaatatttctttaagaataaaaatggaaaaaattaaaggaggttgctaagggcccttttatatcgaacatgcttttagtgtctacagagtcagcacagcgaatatattgggaccaacagaagaagactgtaatccggcaaatgtgagctaagttatggctaaaggcaaattctgcacgtctcctggttaaaaaggaaccctttgataatcaaagtggggtgcttgggaagcgctcagaaaaccaaagggcttcaccttcctttaggctgtggtacattcctaagtatccgaaagtattctgaatcatctacctgcgttctgtcttcctggcacgcgctgactggtttcccatgaaagcatgcaacctgtacgtaagaccctacgctcttgctgggaggcaggggcggggccagcattacctgtgtttctagcatgcattaaccgtggagagttttgtaaggctttatcaacatcatctgaagtcaaatgtggaagaggagctacaaaacaaaacaaaaagcgacatcaaaatgaaaaaaaaaagagagagagagaaagagaattacctttcttacaaaaaaaaaaaaaaaaaaagaaagaaaaagaaagaaagaaaaccgttcccccactcccacactaacatcatgggaagcttataactatttccagcaacctgctacttgttagcatgttaaaacctacatgggggcccgtctttaattcagggaagaagtggttgggatgccaggcaaagcaatggaggagaatttatccacctcactgtctgtcacactacttccttctcaccatgctggacgttgtagaaattaaagcatgcagcaaacattctggattcatgccaacatgccatccctttctgtcaggttaagccgaatcacatgatacaaagtgaaaacttcccttgttctgtgctcaggttagaatataaagtggggcttcatgtagctttagggagaataatccccctaattcctacgaaagagaagccttaatgattctatttcgattcggggtatcatggagacttaactaatgtgtgaccagttaacgcttcctttcccctttgacattccatcttcttggtcgcaggaccctggaggaggcagctgagtgttgaagtgaattttggcttctcctgagagcgctgactacttctcatcaggtgatgtggccagggtgttgctcccctaagtcatcacataccaagcatgtggctccctcggatccccagtgggaactgggcgagggcaggaggatgctgtcgacacacctggttgaaccctctgaagctcaggtcataagaaccatagccacagccatctatccttggaggaagggggagcttactctctctgaggtagtggagatgtgagagaaggatgtcggcgttgtagctgggggtgagcctctggaagtcgtccttggtcatcttgcacagttccttcccatcgatgttctggaataacaagatgttgacgtctggaaggccatattctttcaccgcccactccagccactgccgcacatggtctgtactccatagcgtaggatctgaaaggggtgggaacacattcagtcaattcctgaagccagggatcttcatcttggggtagatccccatccacgtgggatttctgaccagctgccttccacaagcacagcctccagccagcctccctggctacccaggagaacattttgggggaaagacaaaagctgcctcacatccatagatcattgtctttaaagtgaatagttctggaatcttgggattattcacatcacatgcccttgtttttgctcaatctaaagtttcctgtaggcataagattttaaaaattcttttttctcatttatgttcaattttatttatttattttaaaatgagtaagaataagaggaaacttcttttccttagaaaactactggtatatttatatatatttatatggaaataagagtaagccacacatatcaggaaggtgctaattacagatcacaacaacaacaaaaataataataacagtatttatgcaaaatactgaaaaatactgaccacagaatcggaaatgaaatatagatacaccaagactctagcccctcctatgagccagcgttcctcatagagagctgtcagttccagacttttcctgcagggtgtttggttttgcaattaaccagcacctgcaggagtggggttggtgagtggtttttgcattccacagctggccatggcgagcacaaacaccccacaggatgcaggccacgtcgtcacactccagtgctacctatgggacagggagagcagggcccgggggagaaggagcaggtgatctccaacagaaacgccagccgggatgtcctgtggtaaacaccctcagtggtagggtcttcagagtgtggtaaatggggcggctgctcccttgggccccgagccctgagagacacatgggcagggagttggagccctgagttctaatctcaccatttctccactttctggaccttgctgtgggcagctatttctcctttctgtgtctgtcccacctgtaaactaagagcactgatctcagttcccgggacaagcccttaggggtcaggcatgccaggatgttccagtcctcttgaatgaaagtcaggtgtgggagtcacattttagctaatactttcagatccttgtttgtttggtcccactaatattttaggctactcaagaatggagcatgtagtatgctgctgcaatacatttttaggtttgcagaggtaaaccgtaataatagtgagaaacagccagccagtcatacacccagagttctcttcctctccctccttccctcttccttccttcgcttctccctccctttcttcccttcagctacatagaagaaagaaattattgcaggtccagtagaatctacctttcccattccattctcctactgcaaacacctatcctgaagttagtagctagtggttagaagtaaccactatcctgaagttagtacgtgtatcactcctatacatattttaatatttttaccatttaaactacatatattgttttgtgtttttaaagttaacataaacgatatatgatttgctattggcactcaatgttataatttcaagatgtagccaaatgaattcacaaagatatactcaatcattaagcagctcttaggcctcccccatgtgaataatctcaatttatttagtgaatgtcccctgtccatctccatgcatacgcgtgaatgagtccgcattggtccagggcctggggtcctttctggaatcatctggggagactgaaaaactagtgatgcctggtctcccctgggagagtctgcttcaattaggctggagggcagttgggcatcacagttgataacagctcccccaggtgactctaatgagcagccaaggttcagatcatcttccctgggcctcactattccaagcgtggtcctccaaccgcggaagcatcagcatcacctgggagctaattagaaatgctgagtctcaggccccacccagacctgctgaaccagaatctacattttcacatgaaacctggggacacgctggccttggctgagtacctagatacgggatttctgagttacagggcacatccatcttcaacttgaccagctagcattggatgtctaccaatatttaaacacccacattctcacttaaaaatcagtgcacaggccaggcgcggtggctcacgcctgtaatcccagcactttgggaggccgaggcgggtggatcacgaggtcaggagatcgagaccatcctggctaacacagtgaaaccttgtctctactaaaaatacaaaaaaaaattagtcgggcatggtggcgggtgcctgtagtctcagctacttgggaggctgaggcaggaaaatggcatgaacccgggaggtggagcttgcagtgagccaagatcaggccactgcactccagcctgagcgacagagcgagactccatctcaaaaaaaaaaaaaaaaaaaaatcatcagtgcgcagaacctgaaaactaaagggaactctggttttgctacagagagaatatcaacaaaaactccaacggcagtgatgacagaaaagtgtacatatttatttgtcatccaaacacttggaaacatgttgttagtctgtgaaaactgaatgtagatatggaaggttaatgttatccagttcactgaagttcagatgactcttcgtcattggctgagaatttggctttcagagataaaatgtttcttttttcatgacatgtcagaattcctctttctacaaaaatggatcatactgaggtcttagggcaagttctctttacctttggttctgtgcagaggatagtttgttcagccctcacagagagaagaccccccatcctacccaagtcattccctgtaagttccatcctttgatgttagcgaaacccacctttttgttttgttttgctttgcttttaacaaaatgggaggactattttttttttaatgtaacaactgtacttcctagaaataagttcattctgggaacagactttcttctctaaatggtggaaccggatattctcaaaatgacacataaacatattgtctgaaagccactaggttcgtgttaaaatggtgaaaggagaagtttaatctctctattatcccttggtgtgccccttaattggtttcgctcatcaagacaagggttatcctggcccattcagttttcctttaagggaatcaggtgcaagaccccagagacaaagtcctcaacctgtattgtacttatctctacaagtctcactttgagttggtaaaaggctgttctggagttccggagttctgccaatatgagtataaattactacagcctttctgatgaacaacacaataatacaacaatacaacacaacaatacaatcaaacgtctttaaatatgtgcagattccctggcttaaaaattccatttctagaaatttatcctaaggaaataatagaggatgtgcgcaatgatttattgtcaaggatgttctttgtagtgttgtttataatagcaaaacattggaaacaccctaaatgtccagcaaaagagaagcagttttgtaatgcatttaggaatgttcctgtgatatttagagactaaaaattacactgttgaaatatatttattgatatgataaaatgttcaaagtagattgcattttaaagtttcaaaatattattatgatatcattgtattttgcaaagatatataaatatctgcacagaaagaaattcagagggagatacagcaaaacgtgaactgttgtcactgagggaaaggagatggggaattttagatttgtcattttcactaaactatattttctcatttttctataataaatatggaatacttgggttacaaattatttatacaaaatgtattctctatttttcaaagccaaaacatggtcttacaaaaggtatatatatatttaatgtatattatatgtatactatatatcacctatatataatatatgtgaaagtatttttataaaatactttaaatactttataaaaagtattttttaaaagtataaaaaataaaagtaaaaaaacaaaaagaaaagttaaaaaaatgaaactatgcaaagcattttataaaaagtataaaaaataaaactactaaaatactttataaaaatatttttataaaataataaaatatataatatatatagaatatatacttacatatatgctatatatactacctatatatagtatatatgtgaaagtatttttataaaattgctgtcaagagtataaaaagttaagtttcagtttcttttatattttgttaatatagactgcttcatctgaaaagagtaaaattacatgaagtcagaacactcccacatccttttagcatttgatctccacacctctgccctataaatttctaagcaaacaatggtgaaaacaaaacatggccactcggtagaagaaatgagggcattccttttctcctgagcactcgcaccactctcccagacccactccggaggtgttgcaatagaggacagtttgcaggggaaaaacccagattccccagcatgaagcacacagtcctttgttccatgggtgtcattcccaaccattccccctccaccctacatttcctgagccaatgcctccatgcctgtgccacatgccacccacagcgtgaaggactagcaccttcttgtgccctcacctacactcacgacctcctttgggcatctgtcctagatgttctcacagaggaaacacttaacaaatctctgggcagtgaagtgataacaagactgaagacctagtctctgctcacactgaactccacctccactactttggccaggcaatgatgctgcagctgtagatgatggtttttagagttcaggtcagtgcactgggtccaggctgtcaggttttggtcctaaccttttaactccatgaagagccccagtagtctctctagtctcctccacactccatggtatctcagcaaagctttatggcttctgtcacaccaggaatcaaagaaaggggctcatgagttcctatgagattcagcaggcctgtcttcctcctttcttgaccccaaccacacatgtgtaggaggaaggggaggggactacagcataagccccagccgaggcatcacctttgcctatgtttaggtgcgaccttctgccctaggtaggaacacctcttgtctccaggtagcagtgtgtttggaacctgtcatttaattttataactggacctcatttttctcttctgtaaaacaatgtggagaatttcaggacctgagaaatgactcgaataggataagaactaagatagatttaattcaagtaaaagtcattaagcattatgcatatggctatatgcaccagtactatggagattccaaagtgtccaagaccaagagaaacactaaggacccactgagagaggcagcttatgaccacaaccacaaagcagaactaagtctctgtgatcaggctgggcgtggtggctcatacctgtaatcccagcactttgggaggccaaggcgggtggatcacctgaggtgaagggtttgagaccagcctgaccaacatggagaaacctcatctctactaaaaatacaaaattagccgggtgtggtggcgcatgcctgtaatgccagctactcaggaggctgaggcaggagaattgcttgaatccaggaggcagaggttgcgataagccgagattgcgccattgcactccagaagcctgggcaacaagagcgaaactccgtctcataaaaaaaaaaaaaaaaaaaaaaagactccgtgatccaaggaggaagtggaagtgcagagaggtagcaccaaccaggaaaaatgggaaaggcttaccaggagagtgaacttggattaacagcgaggattttgacagaagtagagagaagctctttggtttaggggaaccacttagcccagcctcatccgacatgggcatgaaatatctgacatgtttaagaaaaagggagaaatttggtgtggctgcagtggaggatttcagagagagcacagcaacatacgaggatggggatgaaagctgggctcagatcaacaaggtccttgagtcttgctaacaaggttggattttcatttttagagatttcagagtaattgaaaatttctaagaaatttttaaaaatcttaaataacaccaatcacagaaaacttggtgatgaaaataaaaggctttattgggaatccaaatacccacattgggattcttattcaaccatttactggacgtaaacgtcaacctctctggaatttgttttatatttttctgtgggtaattaaatgaaatgttaggggaatagaaaagtaaatgagataatggatgtgaaagcactttgccaacaataacatactgcaaaaaaagaatgcatccacacactcgattttgcattgcaaactctgctaaaatggaataagaacaaaatctgttatcacaggggcagcctcctccttaagacacaaaagtccaatttataattttattttaagaaacttttggagatgcttctgtcagatgaatcataagccattgaagataagttgttcattttcagccttccattccaattgttttgaaaacatctgtgtcatcattctacatgtcatggacaccaaaatggtaaactgtcatggcacaggctaaacagaagccatcactctctgaagcctcttatttgtatcttaagttacatggttattatgaaatctactttggtaaattggaatttaaaaaacaaataaaagtaaaccattacacacagagttctggagttgtactgttaatgtactctgtatgtggagtgggagtgggggtataagcagtgggagggagggaggaaggctgacatttaaaaaaaatatttccatgaaacaggattctgacctagtagagttcccctgttgccaggaaaatattgagtagatatttaaatcaggcaaaggggcactgcatcgccaaagacaaactgtgcctttgtgaaacaaaatgcctcacacaggcaaacatcttctttcagaggcccctctagagaaatgaataaagtaagattaaataaaagccaaactggtgataatgaaagtcctgaatgttatttttcttaaataatatcaacgtaaaatattggcttcccaaaagaaaaaaattactcttggttatgaaaaaaacatcaaaaaataaaaactaaaatgtacctctaagccatatcacaagcctagtgaggtgtttgtttataaatccaggccctgggcaagtcagccaatctgctgtccaagacactcataagcctgcaaaaataagatttaacatcttgcatcctcaggaggacagaagttacatttataaagcaggcccaatagagagaactggcttaaatttgagcaatgattcactccatcacaaatggaaatttgatctcaaataaagagcctacctcaagactgtttctgagccttttaaatttctaacttatatgtagagttcatttattgttttggtattgatttctaattttattgcacgttggccagtgaatagagtctgtatgaaattaacattttattttattttatttttttgagatagtgtctcgctctgtcacctaggctggagagcagtggcatgatctgggctcactgcaacctctgcctcccaggttcaactgcctcagcctcccgaataggtgggattacaggcacccaccaccatcgtggctaatttttgtatttttaatagagatggggtttcaccatgttgtccaggctgatctggaactcctgaccttaggtgatccacccacctcggcctcccaaagtgctgggattgcaggcgtgagccaccatgcccagctgaaattagctttttaaaaagttccggtttgttactcttttggcggcctagtgcatggtcagtttttataaatgttccttgattgcttaagaaatgcatattctctaatttgggagtacagagttctagaaaaaaaactcttggtaaggtgtatttaattttaatgtcactgacctatcaattactgagaaatgcaaattaaaatatctcactaaattggacttgactatttctttttgcagttcattacatatttcaaggctatgttattaggtacatgtaagtttatcattattatatatttgtcatgaatttagccttttttcactatgtaatgaccctcaattatctccagttatgctttctgcctgaaagtatatttagtctgctttctatttctatttttgtcagctttttaaaaattcaattttcactagcgtatcttattctgtcaactctcaatctttgtttgtgcaagatttttttgtaaacaacccataactgattgtggagtattttttagtctagtctatcactctctgtctttaatggcaaatttggtctatctacacttattatcactgatctatctgatttttaccatcttattttgtgctttatgttaaactttcttagtccattctctatttctccttgccaagtgtctaatcagattgatctacttttcttcattcacttttttttctttgtttctgtattggttttgctctttgacattctagttctctttcctgttaatctttaaacaaaatctaagtttaattaccagtaatttagaaagcttatacttgaatcatccatctctgattttacatgacaatgttccctcatatttttactccactgaattttctactccctacttagggaggctgtggttgtcattttacagccatttctttctagatctaccctcaccttaatcaatttcattgctcccatttccttcctgtatctcactcccttcttctaggatccattttttaaattaaatcttttgttattatctgaagtgaggttcaattagcaacaaactctctttttaactccttcttttatgttcttccttaatatttaaaaagtttatttattttatactctttatccaatactttaattatttaaccttctgcttaatcatgttcattgtttctgttaaatcttggttgggggagatctctcttcagctatttttttgtaatttgcgggtggcagagtcatctttagcgggtctctatctgcaggaattctgtacagcgtaggttgaagacatgtctctccatgaagatttcgtatttacttctgccaggtttcccagattatcactagcccatgaccatttttctgtattaatttctcagccttagagttcctggcacacactgttgtgtgtatggggtggggactcgggtaatgacaggctcagttccaattctctgctttgtggaagctcaagatttcattccttgcccctagttgacctttaaaacccaaatctctgcattatagcaacctaggacaaccaggtgtcaacataagaatgtgctgctctgctctattctcacttttttccttattttagtccctaaggagttcattgcctttcttcccagttcagctgtgcatttaaaaggatgttaaactccatgcagcaattccaggtgttttgcaaaaggaatgtttctcaggtccttttatagtaacctctctattttactagaaccaagagccctctctgcatactttttacctatttactttgaatagttttcatttttaatgcagccatcatcctaactcatgttatgctttacttcattcatttattaattaatcaattgtcaaaaattacttatatgaattgtataatcctctatgaaagattcaaaaatggcaagaaagagtgcctgtcctctacttgtttgagaatctacaattctgtgtattttatttaaaaatacatgactaaattatttttgttaggctctaaacatagctttgtcattctgacacactgatttatttctctggatgaaaccattctcaagtaatcatcttgtttttggataatgatcgttattgttctttgttttcttttgttgttgttgcctcctgttattccatgacaacattgtgtgtgctcatcatgttttagaaatgcaatggcttgttccacataaaggtttctccctgcctgggttttctttctttgtcttctctttaaatgttgctatccccagagtttcatccttggtctacccctctcctctctccatatgtatctttgggcattcttatttgctctcatgtttgaactataacatgcatgctgtattattttcctagggctgccgtaaccaagtaccacaaaatgtgtggcttagaaacaacagaaattcatcgtctcatagttctggaggatcaaagtctgaaatcaaggtatcagcaaggccttgctccatccgagactgtggataaaatctgtccttggctcttctagcttctggtgctgtccagcaattgaatgttccattgcttgcagttgcatcagtccaacctctgcctgtcttcacatggagttctccctctgtgtttccatatcatcttccctctgtgtgtgtctatgtccaaatttctcctttgtgtaaggacaccagtcattttattaggctcaccctaatgacctcatcttaacttgattaaatctgcaaaacctctatttccacataaggtcacattctaaggaactgggggttaggacttcagcatatcttgtgagggaggcacaattttttaacctgtaacaggcagctgtttctgccagtctatatcttgagtccccagggcactctcacagatgccagacccaaatataaacagaagaactgcactttttatcccaggtactgtttaagcatgtcacacatattgctatatttaatccatatagcaccacatgaagtaggaattattatcatccatattttggtgatgaaaaacctgagaaacagcaagattaagtagcttcccagatcccacagttagtacatggcagagtttagaactcaagtgctgtgactcccgatcaaggactttccatcctgagctctaggcccaccacactgcctgacaggtgtcccagaagcatcttaaacacaggatgaaccaaactgaaatcacctattttaaacattttttttttgtatattcattaacacctacccagctgctcatgctaaatctaagctgtcttcaattccattcttctctttgactttcaagaaaaacagataacatcattagcactgtagaaatgtaaaaattagccctgggcaacacagtagattattttacaaaattccctctccacctcctttgtttacttaagtcttatttgaaaaggctgttgcagaatgtctacaacaatttaacaaacacattctctcatcccattcctgtgttctcccctgggtatttttgtcagcacagcttaggaagaagaacccagactgtggagtcagaaagaactgggttcgaatcctggctcttcaaatgattggctgtgacatatttggcaactctcttagcgttcctagttttagtttctttactgtcgagtgagaatgataatgagtacctacatcatagggtggtcgcatgatttaaatgagataatgccttttctacaaagtgcatgtccaagtgcctgacaacagtgcatatcaatagatagtagctgtcgttgctttttagaaaaatgacttgattttagcctcacatttaacccaatggtggtttcctcaaccgctattcagctgataactttaaaatacacataataaactttgatgttagcatttctattttagtgggttttgttatttagttgtttgagcatagcaggaatttaaacagaagattaaagaagcatgtcccatcatatcgacagagtggaagagatcctcgggtgtgttcagggacgtaacaaagaaagatgaagacacaagtcatttcaccagcaggttctgggcctgagaataggctctggtctcacccagttgtgcaagtgttcccgggaaagtcatttcacctctctcagtcttggttttctcatgtttaaaggaagactgaacttagaccaccaagaatcctgcaacccctgcgagtctgcgattcctgctagttagatctagattactgttaacttgataaatcacatttactctcctccacacagaatccaagtgctggctgtgttgtctggcgattgagaacacaaaagacatgatcatcacctcactaaacttacaatctaatagaacagacaggcttataaataactcacgctaagaggattggaaacataatatatcagccatcagggcttggtcggagggtatgttctattacttgttattcactggctttcaaagcccagtgggggaatgtcaatatttagggaggatcatgtggaaactatgcagtcctctaacactctgagaactcaagatcccttctttacatgaaatcagactgccaaagactcatgctgggtgtctgtcctctacctgtgctgagctattctctaatgtaactcagcgctcacagaagatgtcacaagaaataagctgttgaaatgcagtgctgcaactgtggcaggaagacggtcgatggtcaggtctatggccccagtggccccaaaagggatccttcttttaggattctacactatgataaacattgccttccctgtgaaacttcttttttgaaaggaaaaattatttccccaaataactcttttcattttggctgccaggaagctcaaagccatactagaaacttaagtacagcatcttgggcaagcttgtggtcaaaatggctgcattcttccctcacatgctcttggcttctcatttgtatttttaactgccttagcactgattcctaatttccatttgataagtcaattgggtataagcccatcagtagtttagttcacacggcacctcaaatcctttgcagaatatccacatttaagtaagtatatacatgcatttgagaatacaatatgaaacaaaataaagtatgataacaaaataattggtaagatgtcataagaggagtgattaatttgccagaggatcaagcatggctcccttgacagggcagattttgaagatgtctggaagaatgagcaagagcattccagagagggaaccgcagggacaaggacaccgggtggtgaaaatgcagcgcgtgagttggggatgtggcagaggaaaacggcagaggctgcaaagggctttcgaaatcacatcatcgtgggtataaatgaagctgttcttgattcgtcctgtcatagcaatctccattcctcacatgctctgaaatactggtctgagtcattcatttgagctctcaatcacaccttctcctgtctgtcaaaaactacttaccccacatgggtgggtcttagctacttctgacagccttcggtcatctcctcagtgattaagagtaatgggaactccatgaacactttctaacggaatagaaaggtcctagcacaggggtctgagtaagacacaagtcatgtagcttcagccacacatgtttggtgggcaagaaaaggtgattttaaatctcattagagcttttattcacggtgaatggaacacagtaagagtttaatgaatgaattaataatgaagaaagtgaagagatacagtgaagagaagaatgtggctactcttatctctgagattactgattattgcaagggtctatgctgaaagtgaattattttaaaaatagaagcagaggcatttgaaaaactcaacactttagcacctattttaaggaattaaaacagaaaaagaggccaggcccggtggctcacgcctgtaatcccagcactttgggtgaccgaggtgggtggatcatctgaggtcaggagtttgagaccagccttgccaacatggtgaaaccccgtctctactacaaatacaaaaattagctggctgtggtggcaggcgcctgagatcccagctactcaggaggctgaggcaggagaattgcttgaacccaggagacagaggttgcagtaagccgtgaccgcgccattgcactccagcctgggcaacagagcgaggctccatctcaaaataaataaataaataaaaaataataataaaaaaacagaaaaagagaaatctttcaaaatgctataagctgctaaagcgagaggtcctattgcattttggtcagcattttgcaacttttaagaagtgaatggagcctgtgccttcctctttgttagccacttggttagcacatctccatgttcacagccaacacctaaagagtaacagtaactactgcaatgagtgattcttcatttttttttggaatgttaatgtgatactgttaatcatttctatctttcctttttgtctacttgccttttctaaaagtgataaaccatatctttattaaaaataattcaagtctattaaagtaaaatttatatcttctatctagattagaacttttcaaccttattgtacatgaaaattacatacacaataagcatgttaataatgtaaaatttccaaccccacacccaggtttggaacatttggaagtgtgtgtgtgtgtgtgtgtgtgtgtgtgtgtctgggaaagggtctcactctggcttcctggtgggagtgaagtggtgcaatcatggttcactgcagcctcaaacttctgggctcaaagaatcctcccgcctcagtctcccaagtagctgggactacaggaaccaccactacacctggctaatgttaaaattttttgtagaaatggggtcccactatgttgtccaggctggtcttgaactccttggcctcccaaagtgctgggattacaggtgtaagccactgtgactggcaggaaatgtgtatttttaatcataaattttccaggtaatcttgatacaagtggttctgaccatactttgaaaaacactttctaggccaggcgtggtggttcatgcctgtaatcccagcactttgggaggccgaggtgggcggatcacctgaggtcaggagtttgagaccagcctggcaaacatggcgaaaccccatctctactaaaaatacaaaaattagcctggcgtggtggcgggcgcctgtaatcccagctactcaggaggctgaggcaggagaatcacttgaacctgggaggcagaggttgcagtgagctgagatcctgccattgcaattcagtctggggaacaagagcgagactttgtctcaaaaaaaaaaaaaaaaaaaaaaagaaagaaagaaaaagaaaaacactttctagtcaacctccaaattaagctcggccaaaaaagagccatgtaaccagcatgggggatgtcacacttgtcaggcccctcttattacaactggtttcactgaatgacacttgggtttacgacagtgtaagagactgccctgccctatgagagatcctcctagatttacagatactcgcaccaaatacatagataaaaaccagagatgggaattatggcctaaccagtaccctttgggaaggcacaatcaacagtcttgccagaacaacaggcacaaaccagggctgcccagaatgcctggtggcgctactggttgaatgctttgctcatgactccccttatcttccttaggacaaacagaggaacacatcttcctccagactcagaattaatagctggaccatcttttcacatttgctttctttttatcctgtaggcactgaattatccctttcatactgcctgatgatacctcgaagccaaataacacctaccttttgcaattctgcaatatttaaatgttgcaattaaaaatacacatacacacacacacacgtgcgtgtaaacctcactcctggttttactctctctgttcaatttttactttagtccattctccacattcctttatttttaaaaagtggattctaccgtgctctttcatatgtatctatgtgagctttcttaaatctgttctgaaataggaggcagtgtaaatatatcaagtgacagtctacatttatccttcagggacattttctagttgacactttcttatgggcttttttttgacactttttttatgggcttctttattaactcaagatcatgagtatcaaaaccagggttgagggaatcgcttctcaaaagtgggttccaggtaccagaacccaatctgaacacggacaaagccccccagctcctctgtggttttatctctcagtctccgtacagtacaaatttcctcatcagtgtttattagggccactgctatctctagtgtgtaaacatcggcatgtattgatgatggtacaaatgtttaggaataactgatggtttttttttttttcactcagctatccgtgtgatttgcattagtgccaagcaatgtctctaagtagtaaggtctatgtgaaccactcaggaccaggtctggagaattctttttgcacacatggggtactccgtgccccaaatctgccttagtgaggtgcctggataccatggggatggatacagcagctggtacagctgcctgaggtcctgcaacctcatggccacattggaaaattgtccagattgtgcaatgaagctgtgtgtgtgtgtgcgtgtgtgtgtgtgtgtgttcatctctgtgtgtgtatgagcacacatacatgaagcttgaccaataactgaaagactcacaacttgcaaaatcagccacaactagctctcttacaaacactattaactgaataactgcctacactggcgtgaagcaactgaaggagggaagagctgaagagaagagtactttgctccaaagaaaggaaacagccttcacatcaaagcttactataagccaatttgcagagctatccttgcatccatccagctaatatttgatgagcagctactatgtataaaaaatcctgggtgctctgacttcagttgattctctgttctcttccccacacaaatatctctcttattttctaaatactttccttagtgtagaaagactcaagtctggccctactgaaaaggatatttatgacatcaaagcatattgatggcctcatggaaatacagcctcaccagttagaagatggtaccaggcattacctcttacatctgtgattcaatgaggaaccaagcaaggaatcttcagtgcaggccccctcagatggattctctcatctttgagatctaaacactttgttttgtctcctttgaagaaattacattcttaaggaggagggcaaagggtgagatgggttagggggcttcctttgggtgtctacttcactttgttcatgcccagagagtgtctgggcaacacaccactgccctcctgcctctcctccaggcacatcctagccttcgagtttttcttatgtgccacacatctggagtgggcacctgggacatttgtgtttctatttttcccatccaacaggaacagccccctgttctgaggcacagcagcaagtgaggcagtctcaggcattcaggtgcattgtcaagatcaaaccaaatgcatggcctctgtacctgtcaactgcctttcagtaaatactaaggacggttttctccctttcgtaatctaccatcagtgtctcctgtaagtcttaaaaaatgctttgaaatcaggcacaaccccaaaggatggtccctttcacaccccactgcatcgaaccagctttacgtgtttgctgaaagtcacatggtgacagatctaagctgaaacctgggattcaaatccaggccagatgttttgcaaagtaccctgcactcctgaactcttctgtctagaaggtgacagaagcccactgggcatgatccaactcaggtaaagggaaagtcacaccatggagggaatctaacctgtttgccatcacacttcgcagatattaatttaggtgaccccaggagcaagggagaattgagtttgtgcagatttcacccatgcatgcccttggctactttgccaacaaggagtaacttgtacagtgcagctcagtggtgaggtgtccgttcatccattctccacctcccttaatattcactgagcacctcccacttaccaggcactgcaactggccctggagatagggcctttgtggggcttatgttccattcagggaagaggataataagaaaactttttatttttttatttttattattttgagacggagtcttgctcttgtcgcccaggctggagtgcaatggcacaattttggctcactgcaacctctgcctctctggttcaagcgattctcctgcctcagcctcccaaagtgctgggattacaggtgtgagccaccatggctggccagtaagaaaacttttacataaacatgcaatataatggcagaagggaatgaatgaaatcaagaaaaatcaggccaacaggagactggcagtcacaggtggagacgagagcaattccagacggaagtgctcaggactggcctccctgaggccatgacattggcacggatacttggtgaaggaaaatgatatggaactacctggaattaagggtttcaggctgagctgacgccaaattcaaatccctgaggcaggaccgcagggtgaccagatggctgaaacaagtaacaggagggaacccacagaaattgctgtaagcagctgagatttaatccaatgccaacaggcagagactaaaggagtaaggcagacctgcctgagtcctaacttggcctcttattagcctaatgcccttggaaaagttggtggacctctctgaacttcatcttcctcatcagggaaatcatgagaaagatgtccatttgcaaagattgcttgagatcacgtttctaaagcatttatccaaatgcctcctgtagggtaaaggttcactgactggtgactgttgctgttgttcttatatttctggctttaggtagcatgtatcctctgaggagctttaagtcattttttctattacctttagtttggctaaataaataagttcttgtcacgtctttcaagttcaagagctattcctttgggttggttttgaattatgtttgtggtaaagagttactctggttattagaatctgtattacaggccagtgatagctggaattttagatgcttaagggaacacgtaagacagccatataatatatggctcccacatgtttatttttccagataagagaattttaaaaacaaacaagtctatcatctatcataaatagtacctcatgaaggacaggatatttggaacaataatctccaagaagtggcaattcctccctagaaaggtcacctttcatagacatatacacacgtgtgcatatgtgtgtgcacacaagcaaggctgcatgtttgcctggacatcctctttctctctgtctctctccatacgtagtgtgtgtgtgtgtgtgtgtgtgtgtgtgtgtgtgtgtgtatttttctctatgtggcaaaataaagagctggggctacatactgctgtctcacatattttttaaatatttgtatttttaaatacaggtgtatttttcttgctttgctgtcgatccgtgaacatgtcctcatgcatagacctctgccagctcccatttacaagccctgctctggacaaaggagatgtgatcaatgccacaggtgggggagaagagctccctgaggctcagcctagccttggggaagttgcgatctgccgagggcagtgaagctgtgggcacctgacctgctggcacgataactctgcgctcgttcgtggtcatgtttgggggtggcatgtgcttctcctccatgtagctgccgtagttcatcccaacggtgtctgggctgcccaccatcttcccgcctttggccacactgcattcatcaggagagttcctggaggagaagaaatattcttccattataacagcaatcaaagagcatgtctccatcgacttctcacaatacacagagagaaccaaagaagggcaaggcggaagagactgggggagaaaggacaagtgtgaaaagccaaatacaggcggggtgccgtggctcatgcctgtagtcccaacactttgggatgccgaggtgggcggatcatgaggtcaagagatccagaccatcctggccaacatggtgaaaccccgtctctactaaaaatacaaaaattagctgggcatgcctgtagtcccagctactcaggaggctgaggcaggaaaattgcttgaatccgggaggtggaggttgcagtgagctgagatcatgccactgcactccagactggcgacagagtaagattccatctcaaaacaaaaaagaaaagaaaagaaaagaaatgccgaaaacaggccttgccttctgtcctcccgaaatgcatattttgaagccctaactcccaatgtgatgatattaggagagagagcctttgggaggtaatttcagtttgatgaggtcatgagggtagagtcccacgatgggattagtgcccttattagaaaagaaagagaccagagctcgagctctctctctctctctctctctctctctctctctctctgccatgtaagggcagagcaagaaggtggccaggccatctgcaacccaaggacagagacctcaccagagactggccctgctggtgtctgattttagacttccaacctccagaagtatgcaagctcgagtcccattgtttcagccagccagtctgtggggctctgtgaaggcagcctgcacaggctaggacagtgcccatactggctagatgcacagaacacgcacaagggaggcggaactaccacctggcttctgtttcttaagcagctcctcctgaaactgtcatgtcaaaactccatctgtgacaactgattggggacacttgcagggaacagtgaactgctctttgttctcgcggtgtgacagcaaacaggcagagtagacagatgctgtggggcggcaccagggacactcgctgctcagtgaggtttatcctggaacgacgttccttctcaaaacctcagaatgaaatcctcctgctcaatttcaaatccctgcagccaatctttacatatggagctttgaagactcacagtgttccaggcttaggtgtagacaggaagggcagggaagggtgaggactgacgctaggggaggcctcatggggagtggactccagcagtcctagaggacccttgggaaagggatagggaaggaactgtgtggatgcagagaggggtcagctactgactactgaccgtgggcaacaggtcacagggctgctgttagtaaggcagtcactgtcatttggataaagtcaaacctacctttctggaaaaagaaaaggaaaacattttaaacagtgagttgtgaaagctacaggacattggtgaaatcgcatctgatagggaaatgctaaaaagaaaatccagcttagggccaggagtggtggctcacacctgtaatcccagcattttgggaggccgaggtgggcagatcacctgaggtcaggagttcaagaccagcctgatcaacatggagaaacccagtctttactaaaaatacaaaattagctgggcaagtggtggtgcatgcctttaatctcagctactcgggaggctgaggcaggagaatcccttgaacctgggaggttgaggtcgtggtgagctgagatggcgccattgcactccagcctgggcaacatgagtgaaactccatcaaaaaaagaagaaaggaaagaaagaaagaaagagagagagaaagagagagaaagaaaagagagagaaaatccagcttaagcagaaaacagaaaatacatgtcagtgccttcttagatggttaacacgtagatggtaaacccagggtcactgtagctgagaagtattaatatttagggtctgttgtctaaggcggatttccagaaatgcctctcaggctctatccaatgcatacatttttttcatattccttggaatctgggaaccttcgctttctctagattttagatttctatcccagtgtttctggttgtgggatccacgccaatgaagcctcatttatctcctccacttcttgttagttggagttctgcagagaacttggacaatcaaaaaactatgggcttggcatggatgtgaacttcaagtctaaggaggtcaaaaccatctgaggcaggagcgcactttctgagtggggtgagatggagaaggtcattccacacctgaaagccatagctgggatgtggacaggaagggaaagtgtttgttcagcatgtgggaacttgaaaatataggtttgttctcagcatcacttacaaatgtgtctgaagcctatggagggatcttaggtgttggcagtgaagagggtacactgccatctgcggatggaggttacagtcagggtcacgcaggactcaggccctaacatgggcctggaatgcacagccctgcctgatggcatcctcacagctgtgctaacatgaaggaaattttaaaataataatggtctgagttcccatgaagtagatcctgaatatttccaccgctgcctacacatgcattatttcctcttgatgctatttttcctggcttcacacatttatctctaaaagacccatcctaatatgaaaacacagagtgtcttcacttagactgagtttcctattcctctggaaaattccatcagttgagtagagtgtatatgttttggtatatttgtctcaaggagagaagttaccagggaagagaagttagagggattaggttctttaggaaaaagactttgcccagatgatgtgagtaactcaagtaacaactataaaatctagacaacctttgttcagattcaatcattcactcatccatttagacagctgttatcaagtgccggccgtataccaggtcccatcaattctttcttctccaacaacgcagttaacaatttgaaaagtaaaagatcaaagagatgtataaaattatagaaacaggccaggtgtggtgactcacgcctgtaatcccagcactttgggaggccgagctgggcggatcacctgaggtcgggagtttgagaccagcctgaccaacatggaaaaaccctgtctctacttaaaaaaaaaaattagccgggcgtggtggtgcatgcccgtaatcccagctactcgggaggctgaggcaggagaatcgcttgaaccagggaggcggaggttgcggtgagccaagaccacgccattgcaccccagcctgggcaacaagagcaagactccatgtcaaaaaaaaaaagaattatagaaacaggggacattgaggattttgaacccttcagaccaacccctttttcattttcttttagttctttctagtttaattttcatatccgaggacaagaactctaggcatagatcacaagagtttctctgtgacattaaagtagatccttcaggctggttgcggcagctcatgcctgtaatctcagcactttgggaggctgaggcaggcagatcacttgaggctaagtgttcgagaccagcctggcctcccaagtagctggcattacaggcgcctgccaccacgcctggctgatttttgtatttttagtagagacggggtttcaccatgttggccaggctggtctcgaactcctgacctaaggtgatccttctgccttggcttcccaaggtgctgggattacaggcgtgagccacttcacccaggtttctcttgcaaattttaacagcaaaagagtagccttaacatgtttgggatctgttttgggagcttaatagttatcagtcttcaccacagcgaactgtgttgctggcattgtctccactttccagaggtgtgaactgagtactcaaaacacaaggggctggctccaggactcacagccaggaggaggtagaatgagacttcagtgcgggtggcccgaactctccatccctgcttcttaaccctgaacagaatgactccacaaagtaaaggcaagacaatgtcttttcaaaggtaactagatcttcatttcaggaaggcatcagggactccctgacccatacactactctggtttaaggtgtacactaaagcactcatcctgacatactctcctaccctgggactgttcattccctgaaaagcatgtgcatgacacaaacagggcacatatacaagatgcaaataagaaagaggagtgattcctggagaagaaaagaattttcagagatatctgctttacttaagaaaaggacgccaggcacagtggctcacgcatataatcccagcattttgggaggccaagataggtgaattgttttagctcaggagttcaagaccagcctggacaacatgaaaaatgtgtttacaaaaaatacaaaaattagtcgggcatggtgtgcacctgtagtcccagctactcaggaggctcaggtgggaggatcacctgagcctggggaggttgagactgcagtgagctgagatcatgctactgcactgcagcctggacaacagagcaaaaccgtgtctcaaaaaaaaaacaaaagagagaaaaaaagaaaaggaaattttatcacaattcagagaactgaaaagtgttcatttgaaagtctcactataaatacatttctagctctgtgcccaagaaaagatccacactgcacaaatgtgtgtcttgattactccactgcaaccccaccttcaccaggcattccgaggctcacacatcgccgggaaaaagttcccgcaaacagcttggtatgtcacctgcaccaagcgctgcccagcatagaggaccacgtgttctccattctcacatgataaggatttggacgttcaatgcattgttttattgtgcacatgacaaagagtatgctgtgcagggaatgaacagtcctgaagtaggacagtgtgtcaggatgagtgctgcaatgtacactttaaaccagagtagtgtatgggtcagggagtccctgatgccttcctgaaatgaagactagttaccttttaaacatacacatacttttaaacatacacatacttgcatatgtgtgttgcagcagttcctgagaatattctcaggctattcagcaggtgcctgtcaaacagataatcatttagtaaatattaaatgtatctgtctttttgtttggggtggaaatttctttattgcaaataagcgtggttcaagatattgctctcacagactcctttgaggacaaacaaaaatcattttgtctttttatttaatttaaatagttttgggggaacaggtggtgtctggttacacgaataagttctttagtggtgatttctgagattttgttgcacccatcacccaagcagtaaacactgtacccagtgtgcaatcttttctccctcacccactcccatgcttcccccagagtccccaaagtccactgtatcattcttatgcttttgtgtcctcatagcttagcttctagttataagtgagaacacacaatatttggttttccattcctgagttacttcggttagaataatggtctccaactccatccaagttgctgcaaatgccattttcttccttttcatgggtgcatagtattccatggtgtgtgtgtgtatatacacacacgcatatatacacatatacccacacatatacatatgtatatatgtacatatacacatatatgtatatctacatatgcacacatatacatatataatatgtacacatatacatatatatgtacacatatacacatgtacatacgcacatataaacatgtgtgtatacatgtatacacgtgtacacatgtacatatacacatatgtgtatatacatgtatgcacatgtacatatatacatatgtgtatatacatgtatgcacatgtacatatatacatatgtgtatatgtacatgtatacacatgtacatatatacatatgtgtatatgtacatgtatacacatgtacatatatacatatgtgtatatatacatgtatacacatgtacatatatacatatatgtgtatatatgtatatatgtgtgtatacatgtatatgtgtgtgcatatatgtctatatatatgtgtgtatatatatatacacacacacacacacaccacattttctttatccactcattggttgatgggcatttaggctggttccacatttttgcaattgcgaattgtgctgctataaacatgcatgcgcaagtgtctttttcatttcctctgggtagataaccagtggtgggattgctggatcaaatggtagttttacttctaattttccatactgttttccacagtggttgtactagttccatagtggttgtactagtttccatgctgttttccatagtggttgtactagtttacattcccattggcagtgtaaaagtgttcccttttcaccatatccatgccaacatctattttttttttatttttaatgatggccattcttgcaggagtaaaatggtatcaccctgtggtcttgatttgcatttccctgataacaagtgatgttgagtgttttttcatgtttgttggccatttgtatttcttcttttgagaattgtctattcatgtccttaacccattttttgatgaaattatttatttttttcttgctgatttgtttgagttgtcgattctggatattagtcctttgtcaaatgcatagtttgcaaatattttcttccactctgtgggttgtctgtttgctgattatttcttttgctgtgaagaaagtttttggtttaactaagtcccatctatttatctttgtttttgttgcatttgcttttggattcttggtcatgaactgttattctcaaatttacattttcagttccaggttctatttgtcacccacagacattagtcttgacagtcctatgcaatatgtggcatcaacaagagtaaacaggagctgggaagacagatacttccctctgctcacagcagcagaaattccacattagccagggggccccaagaggtggggggctggttcagaattctgagaaagaactgaacaatagcccaatggctgggatattaaaaagccagccataacacctcacaactccctagcaacacccttggggccacacagcctcaaactcctgagctcaagcaatcctccttggttcagcctccctatgaatagctgggactacaggccacactccttgaggagtgtaacctctgcagcaatctcacacttttccatggcatttggtcataactgtggtcactcacaggaacacagaaatagtgtaggaagacaaccaaacattcatgatggaaataaaaaaaaccagaatgctggtgtccttcttctagtaactggagacgtgcccaatgaaactggcttgttgagcttcaaacaataatctcccttaaacagcagttggagaattaagttctaatcatttaaaatcatgagcactgacttcttaaaacatactagtattctgaattaatgagaaaaggacacggcaaagaatatcaaatacattggaaattttgttaaatttgagttaaggagagaaggcagacacgttgctaagcccagttgggttctcatagggttactgaatcagagggctggaagaagccccattttcaagcccccagacatgactgtctggaaaccacttggatgaacaagagtttagcttcgttaacagttttttagggaggggcttcgtaattttcctctgcaactccagagttctatttataaatatgtatagtggttttaaatagccattattcccctacctgtgtgcaagctatgtgaagtttggggtggcttataaaaatacatataagacaaaatgataacataaataattaacagaataaaaatgaggaaacaagggccaaaaaggaattaagagatgaaagcagcccactgagtaagcttactatttatcctgctgaggtaggataccaattcaactctgagctttctactagccaaagcaaagacacaagtgcatctgatgacaaggtttgaggtattaataagctacatacaaaccagttattcagcagaaataaagctctccctgggttaagctttgagagtttttctcggggcttctcatgaagaaaactggattatgcagtaaacaatatcgttcccaacatctcataatacatctaagaccatcccgcaccgtgccaggcgtagctggtggcagagcaggacgctccctgcacacagtgctcacatgctgcagccacagaggatgagagacggcatgtccccagcctctcctccttactggctgccattggaaagatcagacctgtcagagaagtcaatgcaaaaacatgaaaaaaacgtgtaattaaaaaaggagaaaaccttgagagatgcagtgttatacatgcctctagtttcataactcccaaatttctagatttgatttgattttattgttttttaagagacagggtcttgctctgtcacccaggctggagtacagaggtatgattatagctcactgcagtctcaaactcctgggctcaagcgatcctcttgcctcagcctcccaagtagttgggactacaggcacgtgccaccacacccagctgttttttaattatttgtatagatggggtctcactatgttgcccaggctggcctctaactcctgtcctcaagcaatcctcccacctcagcctccccaagaactgggattgcaggcatgagctgctgcactgaaacccctaatttctagattttaaattcaaatttaccaacactaaatagggtcatgtttatgtctcccaagagcaccaaatgcactgtgggtaaacaactctttccaggcctcagttggttaatcttccaaccagtatttcactgttgactaatgatgagcatggctccagactctttccacgtgtttatgttataataaacatatggataaagcatttaacatggtgcctggcacatgaccacgccaggtgtcagctattgctgttagttcatttcatctgcacatctccatgacagaaatactcgaaagcaggagccttgttacagatgaagcacagagaggttggataacttgcccaagatcacacagccagtagtggaagaattgggatttgaacctagatagtcatggtctcgactccaagtacttcaccgccccactctatgcccttgcttggtaaatccgtgtgaggagtctttcatagacctaaagcaccattgaatggatcctcagaaaacttaatttcatcactattaagtattctaaaagaacatcttcagagtggccctgaagacagtcatggatgagggttacagacgtgagctgagcagggcagccacgaaggagcaaggcagggccccgtgggagacttggaaggtggcaatgtttatgtagagatataaataggttttgataagtttggtctaaaagaaatagtcatctcaatttgcagttaagcgttctatgcttctccccaaaacttcattgctgtgcccagcagggtgcatgttttacacagatgatgggcaaacattcttaagtgcaaaaggaaaccagacaaaaagtccccatgacgagacagccgagtgggagtgcatctgactctgactgcaggcccaaaaagatggaggtgaggaccaggacaggagctggaccactggggaagcagtcaatctaattttttaagattaaataaaataagtccaagatgaaagcctccttgagctgtcgtccatacataataccccttaaacaaaaaaaaagcggggttggtggtggggactaatattactgaaaaaacatactgagaaatgtaaaatttggtctttagtctttgaaaaacaaaataaacttggcatctgactttggttttctcacatcagagtctacttacagcgaggcaatttccgtcatggaaagaacccgcaatgaaatggcacagccgtggccattagcttgacaagcatggagcctcagcccttgtgagtgtgaatgggcctcatttatccaagaacggcactgaatacatcccagaggggcagccccaagctcgctggccacattaaatctgattcaccctcacttcagaacacttagcaggggcccactccttggagaaagtccaaggcaagtcagaatgtaattgcggaaatcaatatgtcttcttctttgagtcagtggaggcaaacccgctaatcctgtcgaaaatctacctattcttctagagccatcctccttcctaatcctctgaattcctcttgcacctggacacgactttccaaccccttgttctccatcacatgctggtgaaatgtccccgaactcttccaaagctttctccctcctgctaccagagtgctctcccccaaacagaaatgcaagctgcccatgtccaacctaacccccatcatggcccagagcccctccctagattctcctcagtgatctggctctggagcccctcaattcactcatttgtttagcaaatatctgtggagcatctttctaggccaagcactgccccaggtactggagttatatcagtgtctctattaacatggggctggcatttgagtagccaaagcccctctccccaactccatgtgctctgtgctcaaagaccacattccacatcaccccctagtctcttcccttcaggccttcacttttgctactccctctgccttcaaggcctatgaccacctgatacctgccctattcacctgttcaccacctggtacctgctctattcacctgtccatgctcacctctaggttctctacaagcctttcctgggccgccagagaggaatgtctcccttccaattgcaccattctctgtattttctcagtaagtgtctgcaggatgagtgagtacatttatgaatgaatcttccatttaaatattgagttccttatctcatacctgcagtgcaagagaaagcccctcgtgttgcagtcagaaaaccattgctgaccttggttgaccttagatgggtcacctaacctttcgaggctcaactccttcattcataaaaatgaatggatgctttcttgaggttgctgtgaggacatccctgagatgatgcctgtgaagaaagtctgcaaactgtgaagcactatacagattaacacagcaacatactgcatgtgcatggctgtgcatgcgtgtatgtgggtgtaaatgtgaggctttttgttcttggcaactgttcataactgtacctcggtgaactcttaggtaggtcaggaagctaaggtttactattgtgcagtgttcagcatgcaactgctttttggaatgtcactgtctttctgaatgttccttttggtttattaggttagttcacattaagaagaacttggtgaggaagccacatggaagaaatggaaaggctttctttggcagctctaccctaagagggcaaaggggtcagttctgcgagagaacccccacaaggaggctggcccgggacaagcattccaggcctgtctcaagtctgaatacaaataaatcccttctcaggtggttttcttcataaggatcctaaaagcatatacttagtcctaatcgactgagcaagctcctaatcaagtttcatagtgtgaatcggaggtcagtcaccacaaaaggtatttttaggaccccagacaaggaggggattgtctggagcgctgcagggtaatttgtgggtctgttttatttctgaatcagaggcagtggaaaagctgtttcagaccccatggctggagcagcgggtggagctcagcagtgattcatgtagaactccgggctcaaactgaaaccgtagatgtttgtcttcacagctgtgtgttatttttacccttactaaatattctctcttacacctggaatttcagcctcttcccaacagtcctgttccctcccccttccctgaagcagttgaagacaaaattaattaaaaagtcaccaccagctcaccaacagttagttctttgtccccttaaaggggctcgatgtttccctgagaaagtttcattatttaagtttatatttctctttacagccaaaaacgaatgccagcaagaccgtgttgcttttagatcttgaaaactggagggaaatgcaccattttgggattcatcatttgaaaacaaaatgttctgtagcataagatctctacaagcagttacatgacaaagatcagatgtgacatcttttctatcttgtgcacgtcttttaatttgtctgaaagactcctttttcagagaagaaaggattgagcccaatagccagtatggtgcttcatgtttttataacaggccaggtgaatcctggtaaccaaaacaattttactttctttttttcttttttttttttttttgagacggagttttgctcttgttgcctaggctggagtgcaatggcgcgatctcagctcactgcaacctccgcccccactgggttcaagcgattctcccgcctcagcctccgggattataggcacctggctaattttttttttaatatatatttttagtagagatggggtttcaccatgttggccaggctggtctcgaactcctgacccacctattatttttaaaatgtgattgttttggaaacacctggtgaggttaatgtaaaggtgagtgcaggtgaactgacctgatgtgataaagtaagatagtaataaatgtttctaaaatgtgtaacatatacaaaaaatcaaaatgcagttggcacttggatttggtgcatcttgtcactgcttgtctgacacgtggagagaaccttgctatccctctcaatgcaggaaagacgttcagcttcttctaagaagccctgagggagtgaagaagagtccaggcctgtggtcaaatggccaactttcactttcactaactttcacttgagcaagtgacgaaaacttttggaaactcagtggtcatccgtaaatgtgaataatcataataatgtcatctcatagatgtttgagaaaactggacaatatgttgtataccaaaatctattaataaatcatgtgggttttagaaatatgggttaatattatccctttcagggtctttttctcctgcccaggtagagttgatggtaccctcatatctgttattgctgggccctgaacatcgctctgtactgaatgtgtcttatgatctcacagaatctttttcacctttggtagaccatgagctcctcttagttccttttttttttctttctctcttttttttttttgagacagagtcttgctctgtcactggagtgcagtgccgtgatctcagctcattgcaacctctgcctcccaggttcaagtgattctcctgtctcagcctcctgagtagctgggactacaggcacctgccaccatgcccagctaacttctgtattttttgtagagatgggggtttcaccatgttggccaggctggtcttgaactcctgacctcaagtgatctgcccacctcagcctcccaaagtgctgggattacaagtgtgagccacctgcacccggccagcttcacttaattcttaatccatctccatcgaagctaacacagtccatgatgcagattaaacactaaatacacgttggtttcctgcagcatttgtcaacttcgacactagtgccactcggagccaggtcactctttggacaggtgggggtgggggctgcaggggcgctgccctgtgtactgcaggatgtccccggcctctacccaccagacaccagtaacacctcccagctgtgaccagcagaaacacgagcattggcaaatgcctctgggggccacatcacgatggttgagaaccactgggctaatgaattaagatccactgagctcaggcaaggaggcaagagcctcttgttttacctggtgtttattagagagaagttcctgtccccagtgtctggggtgatgcttaaaaggggcccttaaaggggcctctatgctcatgaggattcctagttatggtttgtccgtaccttgtttggggtacattccccaagccttggcccatcctcgcttcctcttttcctcatgccatatgtccaacccatcagcaaagcacgttaattccaccttccaactatacccaggatgcgactgcctctcccaccctcccttgctaccactctcacccactctcacgcagatgtctcccatcctacacccacattttctcaggaagacttcaacacaggagccagagaggccctgcaaaatctaagtaacactatatccctcctttgcctcaagtcccctaatgatttctgaactcaccagaaagtgaaagtcaaagtccggcaatggccccacgggctctccaaactcatcatctattactcttcttcttggacactaaacagcagccacgatggcctgcttgttgtcctcgaacacctcaagctgacctcagggcctttgcatttagcattccctcctcttggaatattttctgctgtttaatcacgggcattctccctcaactgcctttgcagctttactcaaacatcacttttttgtgatcttctccagccaccttctttagagctgccatccgcttcacgtctttatttttctccttagcatttaccatgatctaacctgctgtgttttcataagtggtctgatgtcatgaccatcttcactgctagaaagtgaacttagtgaggcaaaacttttttgtatattttatcactctatcccaagagactaggaaagtaggtgctcaataaatattcattgaatgaatgaatgactccacgcataaacagtatgtctaaggccctgatggacccagcagatactccctactttttctcatctccatcacatgacaaatggcatgttttttaaataacatctataaaacatcctgctatctgacccgaggctggagttattcatggcatgcaatgaatctatcccagagagaggcaaggcccagatagcattgtctctcgctgcacaggcccagctgggcaaagcgccaatgtggcgggagggaaggaggtatttctcaactcaggcaaggacttctggggaacaaccccacctccgcgtagatcctcccagatcattcgctgggtgggtcacctttacccagctgctgggctttctcatttttcatctccttggatcgtgcaacagagcagtggttctcagactaccaggcatcggaatcccgcagagggctccttcaaacacagcgtgctgggctgccacccaggtctcttccgattctagggcagggcctaagaagccgcatctcaaacaagctcccaggtggaggtgatgctgctggtcccggagcccacgctgagaatcaccacaccgggggaaccctcactcaacagaatcaaacatggcaatggctccaggtggcctgcagactgggctgaggggggactcacagcatggcacataaattgactgagttccacctgcagtgagcctccaggtgggcttcacgaaatcgccatcgcctgtggaaaggggaaggtgccacttagtgtaagctgcctgtgatctggctggcctgagctggggatgctcagatggaggaaaagcagcctgctctgcacagacctgccagcctgctcacgagaagacagtttgcttgtggaccatgagtgagcaggtgttacctcttggcttatcctgctagtctatcatgacttgagctttggggacctcacagcaaattcagggcattggtagggagctcacgagaggctgagcaggcgctgaaactcccagccaggcccttggtgtggatggcacaggaaaacagctggttttagtttggccacacactgacagttctccattgtgtgaacacttggggctttctggtgcgtgaggctagagtgaagaaagggagagggtggctgtggaccaccgaagctgaaaaatgatgtcctgtgtctacacaacgtgcaattagattactgtctgcaagaatgctgctgtttgatctggcagtggccaagccaaacccacaaggacatcccagttggctcgcaaagcagtggttcctttctctcctgtttttcttttattatgctttacagaaactctattataatggcaacagatctcgtttcaccacttgtatttcatttcaggagcttgtaagcacgttaggactgaggttttgtagaattccactattcggttgggaactaagtccttcctttctctcaaagcacatggcctttttctccgtgggtactggatggatagggatggacagagggcactattcccaagctgggtattctaggcagaaggaggtgggccatgttctggaaagacctaagctgcagagagtgcacttctcccgtggaggtgtctgcaagatagtcaggggccacaaaggtaacagcccacaagttctagccaaagagtaatatttgacttacgtaacttccccttggacttgacttcaagtggcatgtgcactacaggaaagcccattatgcataagctaagaggagggacaattagaagaagctattgggccaggggccaggagatgggctaactccctggcacagctggcctggggcttccgagtctggaaggatgcaggtgcaggtagtggagcgttgaggagctgcactcctggcggggctcctccagaggcaggcagccacacactgctctgcagcatctcatctgtgagcccctccgtggcagaatctgcgtctccgtgaaccctgcctctgccctggcccctcgagctgggctgacacagcccggtgctggttcacggtgtccaaaataaagcagagtgaatcacgcccatgttcccttttatggagctgcacctgacattcgtaaagagcccatagtgaggccgggcatggtggctcacgcttgtaatcccagcactttgggaggctgaggcgggtggatcacctgaggtaaggagttcgagaccagcctggacaacatggtgaagccccatctccgctaaaaatatgaaaactagccactcgggaggctgaggcaggagaatcgcttgaactcgggaggcagaggttgcagtgagccgagattgtgccattgcattccagcctgggtgacaagagcaaaactgtctcaaaaaaaaaaaaaaaaaaaaaaaaaagcccacagtgagtcagcaaagcctgcggatgggatcccaggcagtcctttgtctgccccaaggctgcctccaacctctggctgagatgagtcttagctccactgataactgttcagctttcttttcccccattccccttcaggaagcccgttggattgttaatagcagaacactgactcaccacttatgtttcaattctttcagatcactgagcttgagcagccccctagtgaacctctgacctgacacgccaccccctttaccacccgctgtccagtcaggctgagctccagcagcagcggtgaactggccccccagagcacactggtttggagatctaaaaagtacaatgggtcaccagtcactgatgagtgcagcatccctggaagtcaggtgtgggggtcagtttcctgtgtcaacttggccaggccgtagcacccagtgacttaatcaaatgctaactgaggttgtactgggaaggcatttgcacaggtagctagtcagttgaacttgactaaaggagatgatgtcagataatgtgagtgggccttgtctaatcagttgaaggccttaagaacaaagcctgcggtttccagagcagaagaaattctgcctactttccagcctgccagcctcccctgcagatctcagacctgcccactcccacaactgcattagccaattccttcaaataaatatcttaaaatgtaaaaatatcctataagttctatttctctagagaatcccaactgatacaccaggccagcacccagacacaatgccaggagacacactgagctctgggggagacgggcatgagctctgtatctttctcttctacaaaggggattagtgtcagccactcctctccctccccctggaacatccttgtgggtaggggacgatgacacttggtgactggttgacatctgtacattgctagatgcctcaaagcggaggcagcctctgcagccagtgttcctcccctgcctattacaacccagctgcccttttcctcaaaggaggcacgtaggcctggattgaaggcagatgaggtccaccttgttcccttcatgaacagcacctgccaaaccgacatcaccgaacccaccggaggacccggaggatgaagaggatgacatgatggtcttcactcggtatccacccaccaaaacacatcaccgatgctttaggagctggaacagcattgaaagtttatgacggcagcaatctgggcaatgttagaattctatgagccctgagagaggaactcttaaagttcccattgtttccttgaaagaaaatgtcaaggccgggcgcggtggctaacacctgtaatcccagcaatctgagaggccaagatgggtggattgagttcgagaccagcctggccaacatggtgaaaccccatctctactaaaaatacaaaatttagccaggcatggtggcggatgcctgtaatcccagctactcaggaggctgaggcaggggagtcgcttgaaccccggggggtggaggttgcagtaagctgagatcgtgccacttccctgcagcctgggtaaaaaagagcaaaactccatctaaaagaaaaataaaaaagaaagaaaatgtccagttcccctgaaaaagatgtttcccggaaagagaccctcagcgcagcaccagcctttcacttgcctgacagaaaaaccacccaagagctttccccagtctgctgcgctgagggccctggggcggaactgccctggtgtctttcttatggactgaagctcctggtgtctttctttcttatagactgtagccccttgcctggggctcagggttaccccaaactcccaacctgtacccctggggtcacaacacaggctggaaaagcttccccatgcctggccaggagggagaggagacatcagctaccaaggggcatcacaggctcacactaaggaaaacagtgtttgcacttctcccacaaacagaatgcttatttttttattttttatttttatttttttgagatggagtttctctctgtcgcccaggctggagtgcagtggcgcgatctcggctcactgcaagctccgcctcccgggttcatgccattctcctgcctcagcctcccgagtagctgggactacaggtgcccaccaccacgcccggctaattttttgtatttttagtagagacagggtttcaccatgttagccaggatggtctcgatctcttgacctcgtgatccacccgccttggcctcccagagtgctgggattacaggcgtgagccactgcgcccggccagaatgcttattttattttaaattcgggagtaacacagtgagaacaatagaaactttcatttctggagcactgttctcgcctcctcactcagtctcccttcggaggcttgctgaatccagactggccccaggccagactctcaaacaagggccaggacatggctcactctgcctgttgtccatcggaaatcatctcagtgcccttttgtctgagatgtttccttcctctctccccaccttccaacatccccctcctccctgcaggtgaattgctcataggtagaaattagcctctgcagaagaaaagctttagaaatgtgtcccggtcttagtgtctccgccgtgatcacgctggcatatatgggatcatatgaccccacccaaaacagaattcattcagtgtttccaggctgtgttccaccaactgatctactgcataaacactgctgcattctttagaacatgattaccctgcattcttctgtgtttcagaaatatatatagttaatgatcaacagaaacattgtatcaaatgcataggatttatgggtaaaaaatatttacatgtaatcattaatttcccacaactttggtgtcctggacccatcattgcattttctatccaggtccttctgtaactccaggaatgaatctcttgatgagattcaaaaatatttacatgtaatcattaatttcccacaactttggtgtcctggacccatcattgcattttctacccaggtccttctgtaactccaggaatgaatctcctgatgagattcaagatgggcctgcctcgagttccacttaaaggaccagtgcggtggcaatatgtagcatcagagccagtgcactttcaagaagcagatgcacagacgcaaactgacttctcagagtggaggagtgttctggcatctcccatctccccatctggcacgtccagccttgccgttgacattccctctaggacactgtgacttggcaccttcattaacaccacactaggaattgacgcaaccgtttccagacttataaactatgacacttataataaacctttttagcgttaaaacatatatgtaacaaaaaggccccattacagcttcaacagagtggaaaatgctcagggtgtggagtcaaacactcctggtttaaatccaaactctgattccatttaagtggtgatttggggtcagactggaaatgcctgatcacaggtttcttcatccatcaaatggggtcaagtatacttcatgaggggctgctcggaggactgaggggctactggatataaaagggctttgtacacagtaaagtttccgaaaatgtgagctgttcttatgacctgatggtagattatgcaacatttcgaagaaataatctgttctttatcctaagatttgatattctttttcctgaatatatatggggtattagatcataattgaaattaattttacttttcaaaactacacagaattcaacactttttgagggccagggacagttctgcatttggtaatacattttacgtgacagttgtatgttcatgacaaactcagggaagctaataattatgggagacactggagagggctttatgtgtaagctaagaggaggaaaaaaaaaaaaaacaaacagcaggcattaagagaagaggaccgcagagatcagagggtggggtgagggtggagggcagacaatggagatccactagcaaattcaagtggcttggacatacgccgcactgcctggccactagctgacactctccctttgtgaaaacataagacggcattattttccaggcaatcaaacctcagatgaattctgccatatgtgggcaaggctcccctcccacagagccctcgtgcctgggaaatagaattgaacacatcttcaaagagagttcttggtaaatatactactaattttacaaactccatcctctacacaaaccactggagaacacattttcccagcgctgtccaacgtcaccgttcaatggcctttctttctttctttcttcttctttttttttttttttttttgttagccagagtcttgctctgtcgcccaggctggagtgcagtggcatgatcccggctcactgcaacctctgcctcctggattcaagtgattctcctgcctcaggctcccgagtagctgggattacaggcacagtggccttgctttctaagtcaatctttagagaagcatgactgacttccactttgcctttgcaaaggataggaaaatgggaggtcagggagagaaaggggcggaagtctccttaccttgagccattcacctggctagggttacattccattttgatggtgaccctggctgggggttgagacagccaatcctgctgagggacgcgtgggctcatcttggaagtctgtccatagtcgctggaggaggacgcggtcatctctgtcttagccaggtgtggcgttccgtaggcacactcaaacaacgactggtcctcactcacaactgataaggcttcctgaatgcccaaagaaacacataattcaagacactccaacagacagtcatgtttcaaaaagttgttgatttcagagtcctttctaactgggaccacattttagatcgtttttatggtctccatttctacctttcagaagaaaaaagtagcttgtttttctttcctcgggacagtaagagttagaaatgccagcctagaaaaacttttatgcaggtctcgaagcatcccaggcttgactgtggcagggcagcagaatatccactttaatctcaacttaaggaagttgaatttcaaaggtcttagaagacatccaattgcatgtgtcactatttgacaaatgcaatctataattcaagcagacagggtacagagcggtcatgaggattaaaaaaaagaaatctgaaggccaacacctaagcatctggcaaaattgccacattcctggggattttgcggaagagggacttagaggaagacagagggatcaatggagcaccaaagggcaaccaaccaaagatacaaacgtttccactctaagttattagccgaagtacagtttcaagtggtgcttccatgatggtgagcatctggatgataaatgaaccaaaaaaaaaaaaaaaaaaaaaaaaaaagctgtgaagtatccagatgcttccaaacagcaggatgtttaaaatatctggatcactgacaagctcttttttccccttactttcaattaatatcttcgctcttttgcatgatttggtgagaagaaatagcaatttgtcattgttggatcaatcatttttcgtggttttaagtcaaacaagtggttagccaatggctatgtttatattctacagccaatgagcaacggcaagtttgggaaatttcaacgacttaaatgatggcttgtgctgcaatgacacagagctgttgtgatacaatccaattttggttcttataacagacaaaaagaattccacatgaatgctcatttttatattagtcctttggcatcctcagtattgacatcaactagtgagaagcaaaggctagttgggccacacatttttatttaaaaaaaaagaaaaagaaaagaactttggaggcagagcaggggaggcaggggagtgtgggctgcgcagacccttccagtccaaacttgtcatctccaaatgagaaatctgagacccagaaaggtctagagctaatcttgaatgagctggccatgatcaaccaggggattagtgatgggaatgacttgtgtattaccatctgccttctccttgcccccacagccctatgatgccctttgtgacatttttttcctttgggacatgtgtttaaattagcaccctcttccccttctctgagatgacctttacataaataagggtgcttcccatcagtaatcacaccctagaagcagcccttctgagatggagagcttcctctccacccagaaggatcagaatttttaggaaacaatcacccccaactccacatctactctgtcgctcgatcctccacctgtcccaggaccaagttttttccttagcttcccaagtgcacaaacttctttgccagacacacggcactgagaatcagcaaggaggaagaatcaaaacaaactcaaacctctgtctctcaaagtggtggtcaggtgtctgtgctaaagcaaaagcccccatcctggactccataagtatctgtagaattacagccctgtgacaccctgggaaagactaagcctgctgtccaaacagtaatgcaaaatgtaccaaagagtcaggtaggccagacagagaaccagaatcaggcacaagggaaaaaagtcatcttgaatagacagcaaaatcaaactcatcaacaaccaaaaatgatacgaggcagtgacacagaagttgacagtacagaaacggcatcctagatgttagggaacctgaaattcatggctttctcttccagtcacaattgagtggccaaaacaaggaatctaaacacatagatgtgggtttcaaagtaaaatcagcaccatagacttagtcatgctaattaagacaaaaattagaccttattaaaaaatttttgcaaaacagatactcccttcccatggtggcactggctagtgtgttttacaggctcagaacaggaaacagagctgatggctgctgcctctctccttcctgggcctgagactcgaccaaggctcgcaggggaataacacactatgtaatgttagctttggctcacccatgatgagaaacatgaacaaatgtgtgatttatatcagaaattggcgaaaacaggttatatatataagaaacaggctaaatttaaaattacaaactaaaaaggaaatggctgcaacaataacaaacaagcaataactttaaagtattagtatttctccaagataaagtaagcttacttctgcaaacaaagccaatagccacaaaaatgtagtgtaagtttgaataataaaaaaaagaccaaaatattagaactaaaatgaagcttaagtgtgtgtttgtaggggaaggaatccattctcacatctggcaaagcattatttcagcacatggttttctaaagaaagaaatcaaagttaattgagatcgatttaggaaggaaaaaaccctcagaaatgctagagatgggggaggcatgcctcctttttttgcatcttaaaattcttctcacagctaatattgcacaaaaatgaggaagggaatataattcagaatattgaaagcaacccctcagttgcttttgttcattagaagggaaaaattctgaaaataaggaagcttcaggataaacacttcaaaagaggtgaaatacagtccacattttgaaaagacagagcaacccaaactatgccccaaagactttgttgattgtcactcaacaaaggctgctgaacacctaggatgaagtacagctcaggaaaaggaaacaaatgaataaagaaaatctctctcacatacacattttgggagtaagaagaagctgaggggttttcacagacccattcccacaacagcggtcactaaagttaagtgctgctcttcagaagcaaaccaaggcacagccctgccacatctttgtcctcccacttgacttggctgttggcaggtttcatcatcccttcggttaaagcttgaatggacacacgctgctgcatagggccctccctgcctggcagccctgtgacttcaaaggggagagaggatctagcccagtaggattaaaaccagaaaaagagtgctgaacacaggctgctaatcaggaccacatgagttctttaactccagctctgggagagacttcctggccttgactgacatgtctctccttccctgcagcctggctcctcctctttataactagcagatctcacctacctacttacctgcctgcctacctgccggccaaggtaggcagctgccttagttagcatgtatagattgttattgcagaaactctggccagccacaaggcttgggatctgcttcagtggctttataacagagaatattttaaacgtcaaaatctggcagatatgtggcataatcatttcatatgcctgcttctatgttactataaaaagacctgaactttagattggtgtttgccaatgtgtggggtgtttttttctgtagctccaggaaagttgggatattcccatcaggcaaatggcaggctaccaagctcatttttaaataacttacgagaaacacataattctaagcaaattacccccaaacaaaaggtactactgtgttagtactgtagtattgattatttcatttcaatacggaatataccaataacacatgaggaccattcctttggattttggtcatgggataacagttccagaaatgaagggaggtcccaccaggttatatttcatattataactctaaaatatgcatctattttcaagtaactagagtacaaaaaaggatccaaaatacattagaacactgaaaaagaaaactaacaaagttgaatgcatactgacattttcagcaaagtatttcaggaatcctgatgcctttctataacagatgaatactttgcaagatgcctatttctcaaccaaagtattagaaaataaaggcccaaaattgattctaatttgtgatccttatagctcataaaaatattacattgttaatacagagaatccatcatacttaacctcttttgaaaatttgggagtggtaaagtgttgaaactgagaaaatctttaagaatggtcaggtgaatttcacatctggagtaagcaaaggcatccatggtcctttcgtggttttcaaaaattaggaagatggccagaactaggcctctcgagaattggattatcaaacccaccttcaatgttttcaagtcttatatgctataattatttgataattatgaaaaacaaatggaacaactaagtggaacaagaattgtatgatcatgatcatgcttaaaaaaaaaaaaatcttggttcgggcatggtggctcacccctgtaatccaagcactttgagaggccaaggtgggtgggtcatgagttcaggagatcgagaccatacaaaaatccaaaaaaaaaacaaagaaaaaaaaatagccaggcgtgatggtgggcgcctgtagtcccagctactcaagagggtgaggcaggagaattgcttgaacccgggaagcggaggttgcagtgagccgggatcacgcgactgcactccagccgaggtgacagagtgagactccatctcaaaaaaataaaataaaataagaaataaaaaataaaaaaatcttaaagaagtccttgctgctatcacaacacagtgtggagatcattcacttaggaagccagcatcatcttcaatcaatagcctactttttctgtcagttttaatcccattacaatccaatacaaaacccttccttaaatttccctcacatataaccacgcagaatttggtacatcacttaactccctatattgccatcttttaaccactttcataaatagcttatccaccaaataaaccaggttaccttaagcactttcatgcaatatcctcttaaattctattttgttgattacaagatacaccacttgtcacattttatcagctctgaaatatgaaaatgaaaggcttatcctaggtatcaggcagcatttcttcttctctgatggcagataaaataatgggacattttatatccaatgacatcttacattttatgaaaaatgatcatttaatccttacaattgtcctataaggtcagctgtgattcttgcccacccatcagaaagtgcgattagagaagtaacatcaacagtgaggatgaggcagaaacagggtttgtgtctgtgaatggaatcattccccaaggctgtagactggccactacctggctgttactggaaggaagaagttggattaagaaaagtcacacggtggagtgttttggtgcctgctcttgccatgagagatggaatcacctagagagagacagagagagagaggctggtagagggaagagacagaagaaagatgaagggataagtgtccagaatccctggatctgggatggaataaaggatctggatggtaaacggagagtgctgggaaccagtaaggacttctctaggtataccatgctcttctatgagcctaggggatgtgtagcaatgggccctgcatacagttaatcatttcttttgcaatggcttaaatcaacaaccttgttcttttctttgattaatcagattattcagacacaaagacatggccaggtgttgggatgtgttcattgcaggtggatgcctgccttctcttaatgagtactatgcaggaaaactaggacaggtaggagtaccatttataaatatgctggagcctatgccactttgggcggcctttagtggatgtctgcagacctaaggatattggaaatctatctattaggctgtcgcaggctctattgtttatagtttctcttcaaggcagcacatatgcagtagatgcttctaaaaggtctagtatctaattgtatttggaggaggaaaaaacaacacaaacaaaatagacaatgcacttagagaaagctctgctctcccaccataagcctgacaaagatactccagtccttcaggagtttttattctaaatgtgtgcacttttgcaattctgatgccaccagtatctcattaaacaagaatcttcatctgaccagtgtgtcttttatttacaacacacaaaaaagcgaaacgtggtaagtgaaagaagcttcacaaagctgggtatgatcatttttgccccttcttgatatgattttcttttcttcttaattcttcagagaaggaagtattaacatcgtatattaaatgcagcatctagctttgtgttcacgtttttctaatttaacacattgcaattttagtccttcaaaactataaaaaaaatcttggattaacctcaaaggaaaaatgtatgtaggcaaatgaagtccatctaaagagagtatttctccaatatggtatcacttcagtgtcaaataatttcaccactcacaacactagtccagtgctaagaaatgagacccagaactagtgtccagatacatttgcacatacagatatacaaacacatacacatgcttacatatgtacacatatacatgtgtgcatgcatgcaaatacatacatgcgcaaatacatatatacatacacacacatatatacagatacgcacatgcatatacacaaatacatatataagtgtatgcatatatgcaaatagatacctacagaaatacatgcagatatacaatacataatgtatatacaaaaatatcatacatatgtatacatattactaaatacatactaagataataaggagagatgaaaatctttatccttattatctttattaatagaacgctttagaggactttcagatattctttatctttaatcatatccactagggcaaatgttgcctaaaagatacagagaacctggcttcttcccatttcacctctgctccttcctctctcatcctagaaggtgcttttccctatgctcagcacatcccttcagaacagacttagctggggatccatcccctccatgtccttcagccaattttcccggctctggactcacagactttctcagggctctgagaaggcctggctggtgccagcaattctctttgcccacatacttctcccctggccttgcctttattcaaatataagcattttcagggctggctcctctgtatgtctgcctctagaaataagataatttcttaacctcaaatgcttgttggtgttcatattagccctaggactaagacatcaggtgatattacagccccatcataatgctataaatgggatccacaaacttctattacatccaaatgaagagacgtgtttttgtgagatgaatggattgtgtagccaacgcccaggagttccagggagtttggaaaataattgccattggcaatatgtctgcagtcatactaccaaagagcgtattattgcagagtttcaccttcaatccacataggcttaaatagggacttcctatagctaagcaacctatgaacaaaataagacttactggaaaatgaacgtttgcaaaagaaggagggagcattcaatctggaaagcagaaactctagaaatattgtgaaagattggagcatggtagaaaaatgttaaagaaagaatagttatgtccacataatgaaaattagatttaaatgagccttgggagatcaagaatgtcaaccaacatcattttaaaacaactctgttttctcagtgccatgcagaataaacctcgaatgcatttgaaaggacaatgaactgggactctttgccctggcaaatgccatttaactgtttaagaaacaacatgcctgtgatgtgaatagcttcttattttcttctttaaagaatcgcttttttggctgggtgcagtggctcactccagtaatcccagcattttggcaggccgaggcaggtggatcacctgaggtcaggagttggagagcaggctggccaacatgatgaaaccctgtctctactaaaaatacaaaaagttagctgggtgtggtggtgtgcacctgcaatctcagctactcaggaggctgagacaagagaatcgcttgaacccgggagggggaggctgcagtgagctgagatcgcgccacggcactctagcctgggcaacaagagaaaaactccatcaaaaaaaaaaaaaaaagaagaagaagaatcactttttcttcccagtaggcttctttccttctttggagatgagcaaaaagtataaaaacatctgtggaaacctcctgtttgtatgttttacattggaatgggtgcaaaaaatacactcactattcctttacatccttctaagagggctgtttctactcttgacactcaatacttgtttttgtttctctaatcactgttatacgttactcacgaatattcatcaaaacccttttccttattttttatctagttttaaataattcatttgagataaaaagaagtttttctttgctttttttaatcactcagtggaggatgaacatgaagctgtaccaatggataggagaccgtctggtagagcacgggagccagggatagggatctgaagatggaagatgtgagtttcaagctgggctctgcccttgctctgggaatcacctgggtaaatcctttaaccctttcctgccccaagtgtgagctgagagcttgccagaaatgcagattccgagtctccagccctgctgagtcagaatctgctttgtaacaacttccccaggtgagctgggtgcctgctcacttcaacaagtgctgcattatccttttttgactctcaatttcttcaactataaaggtggtactgatggcaaccagctgccgagcagctctctcccaggacagttaaatgggccaaataatctagtgtgtgtaacaggtttcataaatcttaatattgtatttaaattatcatatgatagaagggtgatgtgactgactccaaacctctgcatgtgaaccatcagaattatccattctagtcatattattctaacaagccagatgcaaggaaaatcacagtctcttgtgtgcaaattatcacttattttttgtaagtactggattttcaaaccaagtatctacctaacagaggggaagggagatctagcatcttttacttcaagagcacgtctgtcactttgatttatagcctttttggtccctggtccagttcttttgtgggttttccattcaaattctacattagtttgtttaatgtcaattaaatcaaagctttgtgcaggaaggaatgaatcctggtacactccccagcgtgctgttggtattctctacataacaagataataaattaatagatataccatggtcttataacataatgttctttttctttctttctttctttctttctttttttttttttttacctagaatagcacaaggcacaaagttgatagccctcaaacttctgaagaaaagtcttttcttccaggatgtggaatccataatgctttctatgttaactttccctaaaaattgttgaatttttcataaacttctatgaggaagtgtttccatggcagtctggctaagaggttcacaccatcattctgtcctggtgatttttgaaacttacaagcccaggttgaaactcaggtgattcaaggcttgagaaacacaaaggccaagctcaaggagtagcaaagttgcttgcactttttttctattggcatggtccttctctgaacaccagggaaggggtggtgcaccacctctctcctcttcagaaggagctccgtgaaaaatcggcagttttatgcttggccctttcaaaacacacaaaggctaaaaatacagtgtgctacgcatctggaatgtgtctcatctgtgaatctctgacacatggattcattgttttcgataaaattccaggaattttattcatgagaaaattctggcacaatggaaaaccctggcaagcaaaagataggggcagcagatgtcctggcctccacccacaactctgtctctgcttttagctaattttcatcaggtgtcactctcatgccttcaaacactcaattcaaaatttcccataagacgggggtgagggggtgggggtgtcaaaacagccttaattttttaaataattggtacggtcccccccctccccacagacaggtgtgtcacaccaggttcaacatgcacgtgccaggatgcaggatgggcactttaagaagaagccgcaagaccacagggccactggccatggggctccaccactccgtgcccctcatgtaccaagtcttcaagctcctcgtctaaaatgagggtctggtctactgatgttttctaagactccattttgcaccaaaatgagatcgatttgtttaactagtaacatcctctttcagccatagccaggctgcagtctctacctcctccatctctgagcagacatgcagataaggtagaaatctaccatgtatggagttgctaaaaagttcctatgcatccaggttagatgctaactgcagggtctttccctgctgcccccagactttaattttcctcaatcttgtaggtatctccttctgtgctaatggtaagaagctagtcagcaccctgagagctagtgttatgtttttaagtgtggaaaggatctactctcttgcatgggaatatggcatctgttctacacataaagcacttcaataataataataaataaaaaaatttaaaaaataaaaaacacatggcaacatggtaataccaacagaaagtcttgtagaaactggggttctggcagacagaggagcacatgaataagtctccactattcacatgatggtccaggggtctccttcttttgctttctatccccatccccatcattgttggcatgggccacacactgtataacgcagacatgaacacagacgttttctttttcttagacgctgacttacgtagaaagagttagtcttcacccactgtgagggtccaatccctgccaaggtctttcttcagcttggtaagtgatgatgtctgactccctggggctgggatgctaagcctgtgcttttcagaagatttttccagcacataaatatatcctggttgctgcatggaaaggggactaagtagccaggtcatcagagccctttgctaatgttatacgctgagctcatgcttttcctatgacatagatgagcactgggtagaccccgtcctggtaacacttttcatgcactaacaagttggttgccagtgagacttgatttttatgactctgggagtgctgacctcaaaacctaatacatttgaactaggagagcaatccctccaacaatttcaaactacacatacttacatcacatccaatagggctcttttgccatctggcttgagcccctctataaatatgtctactttgaaagtcacaagcctgggcggggtggctcacacctgtaatcccagcactttgggaggtggaggcaggcagaccacgaggtcaggagatggaaaacatcctggctaacatggtgaaaccccatctctactaaaaatacaaaaaattagctgggcgtggtggcacatgcctgtagtcccagctactcaggaggctgaggcaggagaatcgcttgaacctgggggacagaggttgcagtgagccgagatcatgccactgcactctggcctgggcgaaagagcaagactctgtctcaaaaaaaaaaaaaaaagtcacaaatactctttgaaagtgtgcagagtcattcatatccaaaccatcaaggcctgcccaacagcctggtgacttgaaatcttgacgtgtacacagagtctaaacctcggtctttagattgcctccttactggacctctttacttattaagattcatccttgtggaggaagtgaggtcatggatgttcacatctatctttcccaggaagaaaaggaagcttcaagagctgggaaatgctatgcaccactgtgcaggttctgagcagcacagagccacctgtggggtgggcgggtaggtgagtagtggacatctgaccaccaggcgctgtgcaggactacctccttgcagagcaggtggggccttccaagttgcctactcatccaacctgcacagtaagccttatgggagcgtcatggggctacgcctacttcaaagagcaacttagctaaagggaaagagaatttgcacttgctctcttccactctagcagacttgcacttgtcgctatttatttgtgaacacagactcattttagattgacttaaaaataaaaaaaagtgcaaagaacagggcagctggaagttgggaaaccacttctgccactgctgaatctgaagccttaagctcctgaactggaaaaccagccgactggagcactgagctccctgggccctgtaaaagagcacactggccaggcatggtggctcgtgcctgtaatcccagcacttttggaggccaagacgggcagatcacgaggtcaggagttcgagaccagcctggccaacatggtgaaactctgtctctactaaaaatacaaatattagccaggtgtggtggcgtgtgcctgtaatcccagctactcggtaggccgaggctggagaatagcttgaacctgggaggtggaggttgcagtgagctgaggttgcgccactgcactccagcctgggtgacagagtgagactctggctcaaaaaaaaaaaaaaaaaaaagaatgcaccaagtagtggccagtcaggctcccatgggccttgacacgtgagatgtcaggcagaatttttattaatgaatctgatgccaattcagtatttctgcaatcacaatgcactttcgcaatatttatccaagcaatatttatccaacaaaaatatccaatatttatttatccaggatctcgcaaacgttcagtctagtttcactcacgtcagtgtctctaaccttcatactttgctttcaagcaagagtcgtgtgttggtctgggtgtccgaaggtgggggtggtagctggtgatgcaaggaaccaaaaattggccatacttacttacttaaatatttcacagctctttaacagattctcatctcctgctctcttctcttctccaaccttgccgtctggttctgacactgtcctgccacgattaggagtgagctttttggggttccctcaaacattcactcccagctggtctctttgttacctactcaagagcagttcatactgttggccactctccccttttttaaccctcttttctttggcttccatattcctgctattcctcctatttggttgacaattccatcccccatctctttatgccctcctttttctctcctcattctctaaatgtcagctttcctctgtgcactctcctgggccacttctctactaggctatcatttcttccaagccatcactcaggagccactccaatggcctcagcgctgccaggaagcgcagcgcatttaatttgaagggtgaaactgccttggagggatggcaggtgcatgcttaataacttgtttcccaaggccacataagtgtcattactggatgataattatcagctcaagagggaaagttctaagacagagaatgcaagatttctaaacaggtctaagacagttttccaatgtaagatttattatgtaacagttttgaaagtagtgtctgattccctgtctatatcctccagaacaatctgagggcatggttgccattacaatttactttgggggacgattttatagcacgtcttcacagacaacacgacaaacatctttgcttctgctacactgacaacctgaagttaacatttctgtacctatgtagccattttaatcaccccctaaactggttattccacagcccaggggtgtgggactgagtcagatgggctagagatacctttattcagaggatttagaagtttgcctcagagaaaggccatttctagtctccactagaaatcacacatatcttccaggaataagaatattctcttagtcataagttcaacaaatatgtactgaacaccttttctacttagaaacttgtctagctgcttctagattacatccatgacccaaaaccacaaagacacctatctgcataaggcttgtattctagcactacaagccacagataatttttgaaaatcaattaatcaaccaataattgatagggtaaatttataaccttgtttttcaagcctgatctcagggttagaaggtggtaagtgataagtatgaagaaacagaaggcagaactagagactcaggaaaagagaggtaaactgctgcttttcatttagagtggccagggtggtcctgagaaaacgcgaaggaggggagggtgtgagcccccatgcattcatgaagaataggccttccagccttggcaacagctagaacaaggccagagtggactgcgggggctgcacgaggaacaatgggaccaagaacagccagggaggaggggttactggaaaggagcgaaagaaagaaccaggaggtgaaccaggaaaggctgggggtggtagagccttgcaggccatggcaggaacctgggtgttgactcagagagaagtggagtctctctagccgtcttggctaaaagcccgggaattgtcttcttctgtgttgcactaatattttccatctcataagggttctgcaaagaaaattctttctatctttaaagttttattattttcaaaactaaatgtgatgagaatgcatatattgcatatgccatgtgtacaccaaaagccacacctaataaaatgttacagccatcctttgtcccacatgcaacgggaacttccattcatcatcacatgcagaaactctgggaactgagaatctgtacttttcattcagagtctgcaaggggtcacggccattttgaaaggctttgactcacacaggaaatacctcactgaggctcccacccacccatccactaatagggcagcctttagggaaactgacttgtggcaactgaaaggaataacggcaccaaagtattcccctgccctgaaatctctgtttacctgtggaccggtgatgggtgtgaggctgtaggttttaacgagctctgaatggcaaatggcagacaatggtgtcacttcctttctgcttaggaaggagacgtttggaaaaactgttcactgctgtgcttgcctatggagaacctggattcccagagctctatctggtagaacgtgtctccatattaataagcagtgaatcctcttttgcggctgaattttcctcaaggaagcagcatgggccttattactgccttaaaacccaatttcaatattcgatacatagtctgtgtattcatttgctagggttgccaagacaatgtaccacggactgaggggcttaagcaacagacatttattctctcatggctctggaagctggaagtcagagagcaaagtagcagcggggttgattcctcctgaggactccctccttagcttgtggatggtcatcttctccctgtctcttcatatcatcctccctctatgcatgcctgtttctgagtccaaattacctctttttataaggacatcagtcccactgaattaaggaccaccctaagggcctcattttaattggattacctctgtaaaggccctacctccaaataaggtcccactctgaggtcctgggggttaggacttcaacataactcagggaacactattcaacccataccatcctccaggaaggcagagaatgtgtccctcttcttcactgctgtatctccctgcctagcacagtgccaggtaccacactatgctctgtaggtcagtgattctccggagctctgtaggtcagtcattctcaaagtgttgtccaggaaccccctggggtccccagacccctctaagggcaggcataagcagatctgagaatccagctgcctccaattagcccagacattaaagagattgcaaaaaatgcaaaacaatgccacttctcattaacattttcttggaaaatagagttacttttcataaaaatatctcatttgtgttaacatgcaatgagtttatttatttatttttattttttgagatgaagtttcactcttgtcacccaggctggaatgcaatggtgtgatctcggctcactgcaacctccgcctcctgggttcaagtgattctcctgcctcagcctcctgaatagctgggattacaggcgtgtcccaccatgcctggctaatttttttttctttttctttttcttttttgagacggagtctcgccctgttgcccaggctggaatgcagtggcgcgatcttggctcactgcaaactctgcctcctgggttcatgccttctcctgcctcagcctcctgagtagctgggactacaggtacccgccaccacgcctggctaatttttttgtatttttagtagaaacagggtttcatgatattggctaggctggtcttgaactcctgacctcaggtgatctgcctgctttggcctcccaaagtgctgggattacagtcatgagccactgcacctggccttgttattgttatttttaaatgaatttataagtaaatgtttcaaaatttctgtttttgtttctaccaatagatataatgcatatacacaatttttttttaagaatcctcaaccaatcttaagaacgtaaaggggtcctgagaccaaaagattaagaatcactgccgtcgaggttttaagcttggctaggacacagtctgtacttactgaagtaacccacagtatgacagtaataagacactttatgaagaacatattttcagtagctaagtgtcatagaaaaggaagcttgttagccatttcctcaagttgacaacagagagtccttaggaaaataattttttaaagccaatattgagccttccaagactgcacatggtgatatgttaaatttggaatttatgcaacttaaaaaactgagagtcgggggttggcatttttgtgcatcctaactgacgagtgctgccccagggctctctaacactgcacacagtctactaaagaagcaggctgcccatcatgacccccacccatcagctacacagcacacatctgcttctagatgaaccttcttgcaagtggcctgtcttatggcaaaatcaaggggcaggcctgtaaagcggaccaggaaatgagcagcaactgcataccaccaacctgttgccaagctaactgtgcttttctggatcagaggcagcttgagacactggtccctggggctgagggactgcagagcccgggcacagactccctgcctatctcccagtgtgtccatcttggtacacctggtgcatctctggattggcaagtggcactccccaattaatgttaagggccacttgttttaaatataaccagattattttaatttttaaatgtgtatcccatacttggacactgaaaggtcctccctgtttacctgcttgctggggtctgtgcttgggtgtctcattttattataaaacagagtctcaaaggcatttaatactaagatcaagtggctgggcatccatcatgtgcagagcaggagcctgatggtggtgaaggctcattctgcatgtggttgactctaggaactactttaacagaggggaagaaatacactgggagaaaggagcaggagattcgtcagggctgggggaatactggctccatgagggcagagacttttttctattttttctctttttcagagcctgtaagtgtccacatatcatgcacatgcagtgcgtatttgttgcatgagctcctggtatgcaggtgccaaatgtcatgctaagtgtgtcgactggatgacagaagaaggaaggagggattaaaggaactggtgtgcactggcctgagccttgaagaatggggtgtactgggtaaatcaaaatggtggggagcatttccagatggagaaactgcaaggaaaagcatagaagtggggccacccctcgtgagctggggagggcccagggtatgtgtgctggttggggggaagctgaaactgaggaaattcccattggatccatagcctggttctggtttccacaggcctgggatgccccgtccagagtttgactttcagtctgcacgtaatccaggctttgtattcccacttcccgtatcccctcactcctttttcacacaccctttttatctatgatgctactggggtcatgggttaagaagtcctgtcgtctaagcagcaagggtgcatcaaagcaggattttctccattgattccaaggtgtgattcagaaatggtaaaaactccgaacactaggatgagcactggggatgggttcatgttttttttttatgaaataattcagaacttattaagaattcccttggcaaaccaaattaaatattaaacaactatttgttaatatgttactattggattctatcttagaaaagtgtaattatgtgtaactgaactttttgttttcttgtggttgaaccctgaattaccatgccttctggtttccgtgtttttcctggggaataggtcatatttcttacttccaaagcccagaaataaaagcctcacacatccatccgtagtcccaaaggcttttctgcctagtacccagagagtaacagcagtgcttcaaactatttgtggacaagaagtcctaaaacatcagacacactgtggaaagcaatttcatttcattaatacaattcataattaactgcatttattttattgtctaaattccaactgctaacctatcatatcgacgaattctttgaagttgcctttattctacaggatatgttcatttttagataatgctatttttcatatactttaagttctggggtacatgtgcagaacatgcaggtttgttacatagttatatacgtgccatggtagtttgctgcacccatcaacccatcatctacattaggtatttctcctaatgctatccctcacctaccctcctaccccccgagaggccctggtgtgtgatgttcccctccttgtgtccatgtattctcttgatcatctcccacttattagtgagaacatgtggtgtttggttttctgttcctgtgttagtttgctgagaatgatggtttccagcatcatccatgtccctgcaaaggacatgaactcatccttttttatggctgcatggtattccatggtgtatatgtgccacattttctttatccagtctattgttgatgagcatttgagttggttctgggttcatgttttaaaatctcaatttgctccctagtcctaggaatgatcttctccacctccaaggaatgcaagccccagtgcaacatggattcttcctctgtaagaggctagactccaaataatttgtcctgtttttgcctgtgggatgttacaagtgtaccctgctgtctgtaattgtgtttctgaagtgttctatgtaagtaggtttttgttagttgaattgtactttaaatgtgccaatcaagttccccatgaaaagagatgggcacagagactttttgaaaaattaagcatcccaagagaaaagccgatctgaaaagactacatattatatgattccaattatatgacattctggaaaaggcaagactacagagatactgaaagatcagtgtttgccaaagattagagggagggaggggtgaacaggtggagcactgagggtttttagggcagtgaaactattccgtataatcctataatgttggatacatgtaaatatacatttgtccaaacccacagaatgtccagcaccacaaatgaacgctaatgtaaactacaggcactgggtgataatgacctgtcaatataggttcatcaactgtagcaaatgcactccgatggggaatgttgataatgtgggcaaggctacgcaagtgtaggggcagcaggtgtatggaaatcactctatcttcctctcgggtttgctgcgtactaaaattgctctgagaaataaagtctattttttaaaaaatgaagtattccaattaatttataagttttgccacacgtgcaatgacggccctaaccactttactttggttctccgatactgaatatgtcactgtgaatatctcatcctccttgatcccatccccatcaaaactagagattgaaataaggagatgagatggccctccctgaccgccttgtgcctttcagaggaggtgcctgggctggaatggggaggagctaaggactcctgtgggattctgatgctgggtgtgaaactgtctgcagttagcacggtgttggagagatgagtgctagactttgtatttctggggactagtgataaatgctcattattatttatataattttaaagctacgtttaaatttgtccccagtactagagactttaatgttatattgaaataatacataataggctgcaaatagttatattcttgtcttgttgttgtccatgtatcagcattcttgtatgaatgaaactagaaccaagaagaaaatccatcactacaataatggtccatacattaaaacagtttaggctgtctgatggtctggggtgtgtgtgtgtgtgtgtgtgtgtgtgtgtgtgatatagatatgtatgatatatatgatgtatatatgatttatatatatataaatcatctcatcttgctcaaaacaatatcactcttatttaggtaggcacactggaatatgattttaattaattgaaaagtacagtttgtttcacatttgcaggagtggtttaattcctacacagtgtactaagatggcctctcgtgggctcatgatcctggaagatatactcccaaagtgagggggggtctatgttggaagcaaaaataaaaggaatttaaagaatgacaggtctgggaaattattcttatggatggtcagttcttcatatgataaaatagttatgacaaaccaaacaggcacagtctcatgtatgcactgatttgcatgaaccaactttacagataattgattcagttggttggaactacagtttcttccaaatgtggacaacttacaacagggtgggagccccaaactgtgaagtcatgtgaggtcatatacaaactgaaaaacagggtttctctactggaatgataatcctaccatgttacacttttccccaaaatgaaatccaacatctttcacctggcgtaagaagcccaacatgttctggcccctagaaacccttacatcctgcaaagagggactagagcttgttactcttattagctactcttaaagtcacagaggtagttaatttggcaaggagtggctacaaattcaagacatgtttggatgtgctgagaatcagaatccaatctcggccctcaagtcatgggttaaagacttggttttttatctatatgaggtcctaccttgtagttcaagcagaaacatccaacaaatgaaagcagaaacaacatttgacagctcaaattcaaaagcaagaggcttgtcaatgcaaaagtcttgtgctgcaaatgtttcaagggaagtatccatactctgaagtgtgcaattgaaagaatgacctgatattcttgcactgttgcctcaaacaaacctccctcctcctagctagctccggatcttttatgcatcatatagtacatcttcccaaaaaagcaggtggaaaccaaagtgtgcaaaaacacacattttccaagaacaaatgcattatactagcaagttatgtgtggtggggctaggtgcttctgcgggtgtggaggaggaggagagaaagaagggtcaggaggaagtgtgttgggtacagagacatggaaataagaaacaggaaccctgaaagacacacccgcggaggttctgtaactgtacatgtgctcttgttaaatcgccagtttcagaggactcagatctgaggccatatagaaatctattaatttgcatcttgactttggggcttccagtaacagtaagtatttgtatttcaggatccactcagcagaaaggccatacatattcaagtcacataataaattggtgaattccaagtgaattgtgaataccaaaaaagaaaactgattatgtgactttctggaatatgatgtagaaattgacctaacaaaatgtatatgcacacttacggcatgtgtgcatgagggtgtcatttatgtacacaggtcatgtgcacatccaactcatggccatgcatgctgtagcctgttacccattctgggagatatgtaagcctttgtctttctccctccagcttcctgccttcttaaaacatttcactggtcatcaaccaatgattgaagctgggtgcagaaaaggagaaaaggtgaaaactcctcttagtccacaaggtgacgtgttagtgcttcaagtgaaagggctgtggtggagagccagagaaagcccttaggtggaatgagactgtggttcctataggtcggcaccttcctccccacccggcaggtcagctcatcaattgcacttatctcccagctgccacagcctgtctcactcctttctctctcctgttgggctgctaccaggcctggtaaactattccgtagctctgtgcaatagaaaatagatatgtatttctctgaatatagagagggaaattggagttcacatggaatgcatactgtaaacttatttgttttctgaaagcaaaaattaaacttgaaaggagcaaagcttttcaaatttcccatagtgctggcctcaaatcctaaagatttttttccttgacaagaatcatgggatgaattggaagatctggatgctccattcaccacagttgatgatgctaaaacccatgtgacagcagaggaaagaattgaacattctaaagtcccctctggcaactggaatgccaggggagccttcaccatatacctcatcaagccaccccaacaaacctgccatgtcggtgaaaagaccatgctcactatgaaaatgtggcttctgccgggtgcggtggctcacgcctgtaatcccagcactttgggaggccgaggcaggcggatcacgaggtcaggagatcgagactatcttggctaacacggtgaaaccctgtctccactaaaaatacaaaaaattagccgggcgtggtggtgggcgcctgtagtcccagctactagggaggctgaggtaggagaatagcgtgaacccgggaggcggagcttgcagtgaaccaagatcgcgccactgcactccagcctgggagacagccagactctgtctcaaaaaaaaaaaaaaaaaaagaaaaaaaaaaaagaaaatgtggcttcaagaccagaactctagccctttgtccaaaaaaaaaccatagcccccgagacccctgatggccttgacatgccactgggggtccccttatctatttacattatagaagggcttctaagaagaatggtttcagtcagagaatccaagcaacttatgctaaagtccagcctcatcctcagaactctgggcatgcttgtttttaatgccatgtctatccatctgtgactcattaacgcacttagcaaacactgagtgactgactagtctatctctccccgtgataaaatttaaacgcctcttacaagacatgagtagtctacctacctgttacttgtatgccattacctgaaaaattcccatctgtttggatgcaaacttcacagaaactctgccacaaatgctcacgaacaccatcacatgggctgggctctagtgctttggaatatcctactttcttagaaaaatcgatgagtacatataaatataattagctgcaccttgattcctgcggaatcattgtattaactgctttgggctattctccttctttcctttcaggcaatattaatttgtaacaaacacattttatgatataataaattatctttcattttttactatcaaatacatggagaagtaaaaaaacaaaaaacccagaacttctaggcagctcttaaacaagtcttgctgttacttggaaaagtaacaaattcacaggtttattgtctatgttaataaagctgtgttggagtagtcattataaccttttacattccctcctgtttacagctcacagaatatgtttacacatgtgatctcattcagttgtaacatgatctgcataaattatgggtattaacacttgccatatttattacaacgatttccccagcaatttgtcttcttaattgtataatctatattgcaaacagatgtctgcagtttgtatatgcagctatgtactcctatggtttatgcatctacctcaggccattaaactgtaagctcctggagggcagggatgtatctgattcatttctgtatctccggaacccactgcacagctgctgaatggatacacatctagttacttaacctctgtgtccttcagtttcctcatctgtgaaatggctataatgattgcaggaacctgtcttctctgtcccaattgtattaagcaaaacacttaatacaatgtctagcatataataagcactctatgagtgttttctattattattattattattattattgttataattatctggagttaattgaattaaagttcaaaaagatgacctaactcatttgggggaaggtgatgaataaacggcagaaagaaaggaatatcagggatcttatatgctgatcctagctttgtctaatctgccaagctaagtcgtaagatttttctcttttcaaaatacttctgttaagctagtaaaaattatttacttgtaaagattccatgtgctgctttttctgtcataattgcatttaccttaccaaatacatattgaccatctacacagtggatagcagaggggccacagaaatgagtaaagtctagttcactctgcactggtatctcttttcttccatatttacattttataattacatttgtcaaactgcttcacaggcgaagtcctggaccaggaaccaaataaaattgacccagctttccgaccatggaaaactaaaagtataatcaactttggcaccattaaattctgtttcatttattttttccaagagtctattaacattgtcatacagaagtagaagatttaattgagtgtgtgcattttgagttgaaagcagatactaacaagaaaagctaacctggaagacatcttgtaaactgtttcatcagactggaccaggagccaggggagggtcgaggtgactcagggctgttggcaaagctgcagaaattgccactgggtttctctgtcctctaggcaacctaggctgcattggctctctggcctattattcattacggtttagttcaccacagaggttgccagtgagcagtgcataagattagagattttgtaaaaacatgttaatttgtatgaagacgaaaattggactatggagtttagtgataaaaatagataaacagttctgtcatttgatttaaatattaaaataagacaagacaaagcttttaaggaaatgaccacttcttggttctcaactagaggcaatgcctcttctgtcctgagcagatgggtgtttgggaatacgtggggtgacttgggttgctgtgataatgcaggggttctctggcaatcagagggagagggaggggcaccttcaaactgtggtccagatctacacaatcaggaaaggctgttcacctaaaattcaaccttctgttgagaagagcaacacttacggagctcatcaaagaacgacaaaccactggaacagttcttgagaccaaagtctcattcactctgggacatatccagttacataaatcatttatgttttatcccgtctctactttcccaagaaaccctgccacacattcatagtgaatatcaaacctaattaaagatcctaagcagctgagaaaattactcaatgaccaaactataattagtcttctacaagggagaaaatgtattcaaatcattgcttaattttgtttcatttcctcttacctgcacttgaccattaagatcaaaagtctgagaatttgtggccaaaaaaaatgaacatgagtcaaagtcacatctatttgttaataatggaaagtaattccttttctaattacacgtgaaaatactagtatccaacaaacctatttgtggaaaatacggtttagattgggaaggttaattactttcaggtttttcaatgtccaaaacacacctcagaactaacaggctcagacaagatctttatgagatcactggatcctccctccaaaagcttccccctcccctgttgatctctattccatatgctgcttcatttgatcgtatagcgtgtatgatgagcctgaatgcgggcatttgttgatttgagtattacctgaaacaaaagatacaccagaatgtaaaacccaggagggcagagactgttttcccagaacctagaacaactcctggcacataccagatgtaaaatcattgtagaaagaaagaaagaaagaatgaaagaaaggaaggaaggaaggaaggcatgaaacggtgcactattattgtatgccaccttaagtcactcatagaaaatactgcatgccagcactctatgcaatgggtgttacactagccattatgtaaagtcaatgacgggattatacgctgggcactttataatttaataaacacccttcaattaccgtctcatttgctcctccatgccactccacatagtatacgggacatattttaggatcaccagtttagagataaagacagaggttgtgtccccaaagtttgcttgcgagtgtggtatttgtaacttctaaaactctaactctcccctgaaaacacgtcctaagagtggtgaggctcccacgtgaggtggcaatattggttacccccgctgagctcatcacattgcgcaggcctccacagggcagctacactctacgataaggaacatgaagccctgagagtcaggagggagaaaaaagaaaatgaacgtttggaaaagggcattcccaaatcacaggagaaggggaagaaacgtgtctcagctactaagtttctcttttccatgacgctcaaagcagaaaatggctgcacgtgggcaattcgtgcgcttggagctcagacctgcagtcttgtcgtttgtctgccctgtcttggtgcatgctgggcctgacttttttatttttccatttcaaggagccccagcagggcctggaggaaatgagttttgcagcccatctcggcccttgagcttggctcctcggctgacctcggctccccgcctgcagacccggcatgaggcaggcagcaggcactgcggggcagaacttccgggacctgcaagaccagtccgctgccttctgagacgtagttctgaggtgtagcaagttttcattttcacagcataaaaccgtctacaaatacatacttcaaaatgaaatggaggatgcgctcaaaaaaaaaaaaaaaaaaaaggcttagagacacgtcaaaagggcacaggagctcagccaggtcaaataaattcccaaatttgactcacatcacttcagcctcatctggatattacccacactctgcctaggcaggcgaagcttccgtgggatcctctgtctttagtgaattctttcctttatcttgtccagcttttcattgctctttcagaaactgagcccatggttttaaatcttaatatgaccttgcattcaattatatatatacatatatatatatatacaaagctgttttttaaagacaattttaaataagaaaaaaataattattttagataccagagagtggtgaaataataatgattcaaacttaatcctcacttcacgtaggggaaattgactcaaatctgggagcatcaaaaattaagatgcatttacaaatcctaggagaagatatcctttgtaatctcagagaaaataattgagagagggaaaattttttttgaaagacgtggtttggacatattactattttgtgaaatgaagttaaatgtatggtacagatattaaagttcacttaagttttatctatataaagtgtgtgattttggatctaaacaggcataaatatatatatgtgtgtgtgtgtgtatgtgtacatgtttgcgtacgtatgcatgtgtatgtgtacatgtttgcgtatgtatgcatgtgtatgtgtgagcgtatgtgtgtgtaagtgttgtatatgtgtgtatgtgtgtgtatatgtatgtgtgtatataataggaagtaagttggaaaacatgagccaactgacttttttttccttagacagctaaagaagagtggttagaagtttactcacaagtaaatcttttaaggagcgtttacttcccagaaacagcaatgagatcttggaggggcaattcttgtcaactgtgcatcatcaatggagtttaactgtgagaggtaaaacccattgttggtcccgactccaccaacccaaatggtcatatctgaggacttcctgtggttctcccgcccccaccctctccacggcatttactgctcctgtataccctggacttctcgacaggaaatggcaaattcctcagtaggaaagccaagaagtgggaggtcacatggagactggaagttcattgcgtgcagcccctccaggtgacaggcgacaccgcctctgcatgttgagtgcctttgtgacacatgatctccttgtctcatgaccacaggcagcagggtcctgatgagtgccctggagagaactgtcctcccacccctgggtgacacagagtctcagaagccagcagaggtgctgcaccaaaggctcagactttcaccctgcctctcttctcctcaactctttgccctaaaaaacatgtgctttgagggtgtgttgaaaatctcactaagtcaaatgatgcctgtggggcagaaataacccttgctctgaaagggtcaccaaaaagtcatgagactcctacctgtatggaaggtggtgactatatagcccttgtataaacaaacaaatacggtgaaagacttggctccatttttttttttttgtctgttcgttattttttggagaaaacgttgtgataagaagcctttagcctacaaaaatgtctctagattaatgataatttatctcacttttctcagtgaaacagatgaatcaaagaaagtgaagcatcgtagacaatataggaccttcctgataacatctaacatttaataacgtgatcacagcgtggcggctctaaaagacatgcacatgtgaattaatgcatctaacctgcacactagctaccattatgcccattttaaagatgaggaaaactgagactccaaaaattaaataagttgcctagagcatcttgccagttaatgcaccagaattctaagccagctgcctggttccaaagcgcatgcccataaacgcggaacataatgcaccaaatggcctagaactgaaacgactgcaaaaataagtcaacatatgagaaactagagaatatataaagccagccccaccataatcagtggcaagggatgggagatgggaagaagggagaagggaagggaagctaaataatttcagtttttctctgtgcctttaattcctgtcccctgaagatgacacgctcattttagtagcaacccatgaccaagatgcattccccaagcttttcgcacctgacagaaagggactcggtgtccaggactgtgcccgattacaatcaaagcagatggacccttccttagggtagggctgttcttctgacagcctcctctgtgaaactagattataagaggatgtgctgctctcagacaccctctgcctgtccccgccttggggtccttgcctttgccattcccctggtccgcatcactcctccgaggcatttgcaaaccttgttctcaccttttctttgggtctctgtctgacaggccttgcctgatcatgttctctaaactagaggtcccgccccccggccacctggctctatcatgttccctaccttccctcctaaggctcctgacttcctgccacactctgtcttcgttgagctgtgatctatttgtcagtctcccccatctgcatccccctgattgacagcactgagtgagcccagctgtcctgctgctcatgcccctcagcacccatgagcctagtgggtgcccagtaaatccttagtgagtaaatgaatgagtcaatttccacacaccaaatcccaaagggataaaaagacattgcctttctgccatttcttggaagaattttttgagacaaactaaagaaaggaagctacttgttattaaatttttaaaaatctgcctactattttcaggcaaatatgtcatgatgacatctatgaaatctctgaaattaaagagaagcctgacgtttcacaggaattaaatgaagttgctgcatcacaggtgctccctgccacagggctccgtgtggcagcagcaaacagaactcctcgctgcttaggtgtagtccttaggaatgaaaatctgaacgtagtacgttaaaaaaaaaaatcttcaaaagcaaacaaagccctaagtgtcgctgtgtattatcagggcagggtcctcctcagagagaggcgggctgcaatcgcccctacacctttcaccaagtgcctcgcttcaggggtcccattgtctccacgtttaggtttaggagcctggctcttcgtaacaccagcgaaacatgttctcctaaagatgttccctgagatacaacaccactccgcattgtttcaccacataccagcattaatatcccagagtaatccaccctcctcttaacggctgatgacggctccaatggccatgcaaaaatcagttgaaggaaagggaagtcttgtcggaaatgagattagtcttgtaacgagtgttcagccctgataacccatctgggcacagaactgcttaaactggagagcaattaaccttcacccgacaagctctgtccaaccgttataaacattaaagagacagaatccttcccccctccttgtagactaaacaaccagatttgaaattccacgtaaacggcctctttctgcagatgtgcaccaacaacaacgtttagggggaaaaggtgggcaatggctctgttcataactctggtaacttttggccttggtgtgagtgggctgaggttattagcgtaaaaattaactggaggtatttccaataaaatcaccaggtttaggggactggacatagttgctttcatgcagaaacccatgtgtcctataggaacacaacttgatgcttgagagattcttttttcttttctttctttcctttttttttttttttttttttttgagacagagtctcactctgtcgcccaggctggattgcactggtgcgctcatggctcactgcaaccttgacctccccaggctcaggtaatcctcctacctccacctcccaagtagctgggaccgcaggcgaaggccaccatgccccactaatttttctgttttttgtagagacaaggtttcaccatgttggctaggttggtctcgctcaagcgatccacccaccttggcctcccaaaatgttgggatgacaggcgtgagtcactgcgcctggacttcttttttcaacagtagaaatatttgcactgggctagactctcactcactcccaattcctctcttccgacatttgcatgagtgatgctgcttgtggtcacagaagggagattttttttttaatctccgagaagttattggttttcatggggagcaaacctgtgatcttgcctttatcagcatttgccgtaaccagtcgagttaaccaagttgggccatgtgaaataccgagtggttagagaatctaccaggaaacctactgttaaaaataactttcacaacactgaagagaaatagctgaggtcacttaatttatcactcaggcatgagctttctttagcatcagttcatgctgagccattggcttgtttatggacatgatactaacaataaataggtaaagggtaagggccctatgacatagagctggctacaaaccaatgtggggtacacaatatgcctagcatttaaacaagaaaaaaatgtaaagtacatgcagaaagtcatatgagggaaccaaacctctatgttactgacctgttaatgtgactgcaactcagatttttttaaatagaaagaaaaaaggaaaacatatatttagcatgtcctaaacaaatttatctccccaaggttttagtgcaatcttcatgatgacctgagatagctatcaaaatagtccatcctaacattcgatcttatctctcccttgaacccagtttctctttttccagtaggtaagtcataatactccaggcctcagagacgtgtttgcacacaacgaggctgagcctatctcacttataaggatgacatatctcactcatgctggactccagaccggccccaataacagttttggagagtggcatggtagaggatgtgtgttacatgggaagtactactgtaccctgggacaagatatcctggcaacaggtcttgttttcatggtttgcatttacatgcttaactgttccttttcctgcctttgtaagactaagaaaatccttactgtacagagaaggaactgtgaaaatagagcaagtgggactgactctcacattgcagggatatgcaccatctccatttttgcagccaaattagatgcaagcccaggattccactggcctggttctcccaggaacactgggagtttcttggtgtcttagcttgaggtgaggtgaagatgggctatgggcacgtgagctgaccagtttttcatcctgtgtgcattggacgtagacaagggcacacacagacatgacaagaatccatgacctagctcctaatgtaaatcttctttcccaagacaatcttgcagagccctcatggtcagtgataagaggaacttcaatttttatttggaatctgacccatttcataagaatgagtaacacctgaatatttaggtgcagatatcaaagacagaagacaaaaagaaatcatagtgtttgacaataatattagtataggatgccgttttatgagttcagtcttaggactgtgtaggtgcaacgtgaagactttcctgaagacagccacatgaatcatttttcataggatgtaatcaccactgtcatccattagtccaggcttgacacatagaatgggggtgactggctgcctaagtaacaaactccccacgtgtgcttctgacgaactgtgtgggctgccctaagcttttgcatgtctcgacacttaccaagtaaaatgatgagataaggaaaaccacaacatcatactcagtatcttgtgaaactgaaatggttgcagagtaaacactttgccttacagtgattttattttgactattatgctggatttaacaatataatggttaatatccatgctataaagttttattttttcatcaacaaaactaattgcattggcactttcaaaatgttgtttgcacataaatgatttatacttaagtatgagtgtaacaatcttgccatcaggacctggtctgttgggagatatcagtgaatggagcctggctcttccaatgggcaaccgttgtttgttggtgaagctgccacccttgagacctgcctggtctccttcccacctgtagctggctaagtagtgtctccccacaattcacgtccacctggaacctcagaatatgaccttatttagaagtaggatctttgcagatgtaattaatgattaaaatgagatcatagattagggtaggttctaaatccagtgagagcatcctcataagaggctgagcaggacacacagaaacataaagaagaaggtcgtgggatgacaaaagcagagacggaagggatgcatctacagcagtctccccttatccacgggggacacactacaagacccccaggggatgtctgaaacctcagacaggactgaacccaactgccattaactggaacactttctgttccatccacaaatgcaataccttttccatcttaactaagcacttactatccactgtggtcatcagttttgcagtttgaggtgcaacggcaaaacaagcacagatttctttttatttcttcaaacttcaaagacagaagattcattcttactgtacatcttagcaaccacagcatatgatctttttccttgtaagtacagaactttcaccttttcactgaaagaaagcactttacggcttctctttaacatacccggaattgccaggatcagtcctcttgtgccttggggctactactgaataaaagaagggctacctacacataagcactgtgataccgtgacagtcgatcccataaccaagagggctactcggtgactaacaggcaggtagcatctgtagcatggatacggtggacaaaaggggaattcatgtcctgggtggagcagggcaggatggtacaagacttcatcatgctacttagcatggtgaacaatttaagacgtatgattcatttatttctagaaatggccatctaatatcttcagacagcagatgaaactgccagaaaccatggaaagtggaatcgcggataagagaggactactgtccaagccaaggaacacagggcttgcaggcaacccccggagctggaggaggcaccagatgcatccttcctcacagcctccagaagggaccaacccagccaacacctcgattttggatttctggactcccaagctataacagaataaatttctcttgctttaagccactaggttgtaataatttgtcacagctatcctgagaaactggtaacagtacttgtggatgctgtttttaacaaaaattttgccactttagggcactatatggcctttttttttttttttttttttttgccttatagagttaggtcaatttccaaaagtgctggagtttatgccaagaattaagtgactccctggttgcagtggccaaatagcctgaaattttcaaagtaatactaattttgcaaaacttttcatgtaaactcctttgcctgaccatgccctaatttttgtgattaggaaaatctggctcttatcccactggaggaaaagtgtctagttcatattctaatggaaatcatcacttgggaggtgttttgacaaacatctctcagttttgtttaaaaattatgttagaaattaagaaaaataacgaatggaaaacaaaatctaatttttggtatattttcctgctaacatttgtgggcaaattagttaaattatgattgtttcatgcatacttactcctccaacagcatcctagctctcttaggagttccttttaattatcctaaaaacagttaagagtatactgagccaaaatataattaggttgagaaacaatgaactcctaaatgaccaatcaagttttttccaacattttaattctcaaataaaggtcatttccttttatttgactccttaaaaactagattatagttcttctaggagaggaaccaagtcagatttcttttaatcacatacattgccaaatgcatgctttactcagggaaagatttcaatatgcatcatttattcatgcattcattcattcaggaaacagagtagcactttacatgcggacgctgtggaaacaatggtgatatgaattcttaaatgattaaagaaacagtccactaaaaatcttatcaagataatagaatacttcagattttatgaaagattacattttcattggcctatatataatgttttaaccagtaaggctcactaagttaaataatatgctggataatcttaaatttacagaagggttttcagttttactatttggcttagataagctggtagttacttgctaaaattaatctttattataaagcagatcatcttgaaactgaatacaaaaacaaacgtagctattattgaaaatgttatgctatctcatatccattagagatgttatttatataataagtactgtgttgtaatttgcctgattccaatgaatacagaaaccctcagtgtgaatcaatatactagacaccagcagacatatttaaaagattgctacagtttcactgacatttcaaagaggtgactgtagtaacaaaagaagaaaaatgaatagtccctatcatagcacattaatacaacttgtcactagttcatgtccagaaagacttattatataatagattgtcaaagttgaatatttcaatgacccaatgcaaatcctggataaatgctggtaggtgttgctgctcaataaaaatgaaagtggtgtttggttttgctcatcaaggcaagtgtcatgtagcaaaatgcaggctatgggttgcctggaaactgtattcctgcttttaatttacaagtgaaacattcccatccatggcctggaagggaccatcatgtactcggcagcactcattagattctgggcagcccccggtcatctgaccttcccaaacatagggaaaggacgtggatagacattttcccaaaaagacataataatgaacaatgggtatacgacaaggtgcccaatatcactaatcatcaggaaaatgcaaatcaaagacacaatgaggtatcacctcacgcctgttcagatggctatggtcaaaaagacaagaaatagtaagtgttggcgagaatgtgagaaaagggaatccttgcagactgttggtgggaacatggaatgttgcagacactgtggaaaaaagtatggaggttcctaaagaaattaaaaatagacctaccatatgacccagcaatcccttttctgggtactttcccaaagaaatgtaatcactatctcgtaaagatacccgcagtgccatattcattgcagcattactcacaatagccaagatatgaaaggaaccaaagtgtccatcaatggatgaatacataaaataaattgtggtggatatatacaacggaatatcatttagccttttttttttttgagatggaatctcagtctgttgcccaggctggagtgcagtggcatgatctcgactgactgcaacctctgcctcccaggttcaagtgattctcctgtcttagcctcccacatagctaggattacaggcacccacgaccacaccccactaattattaaatttttagtagagacgggctttcaccatgttggccaggctggtctcgaactcctggcctcaagtgatccacctaccgtggcctcacaaagtgttgggattacaagcgtagccaccatgcccggcccatttagctttcaaaaagagattctgccaattgccacattatggatgaatctggaggacgttatgctaagtgaaataagccacacacagaaagacaaatactgcatgatctcacttatatgtaaaatctataacaaacaaacaaacaaagactcaatggggaaatggggagatgtaggtcaaagaatataaagtagcaaatatgcagggtgaacaagtctagagatctaacgtacaccataagggatatgcttaataataccgtgctgtgctgtacttgggatttttgctttaagagtagattttaggtgctcttgccccacaaaaaaagaatgtgtaaccatgtaagatgatggatatgttaatttgccttcactatcagaaccttatcaccatcttcatgtatatcaaaacatcatgttgtacaccttaaatatataaaataaaacttttaaaaaataaatcaaaaagtcatagttcaaaccactcttttggaaaagtatggatttgttaatataagtggtatataacaattgtatatgcatctggggaaaatggactccatctttcatgatataaaaagcaattctcggccaggcatggtggctcacgcctataatcccagcactttgggaggctgaggcaggtggatcacgaggtcaggagattgagaccatcctggctaacacggtgaaaccccgtctctactaaaaatacaaacaaacaaacaaacaaaaaatagccgggcatggtggcacacgtctgtagtcccagctactcgggaggctgaggcaggggaatctcttgaaccccgggagagggtggaggttgcagtgagccaagattgcaccacagcattccagcctgggcgacagagtgagactctgtctcaaaaaaataaaaaatttttaaaaaacagcaattctttgtgattttaatatagggtgccagccacatcactgattcatgcactcactcatgcatttgtcatgcaggaagttatttattcatttatgaaatggacatttactgatagcctgctttttaataggcaccatcagcatgactgaaaggttacatgacaacagccacagaacttaaggcatagaactttaacaacacacgttttgagttactggtcttgacgcctggctaattttttgtattttagtagagatggggtttcactgtgttgcccaggctggtcgtgaactcctgagctcagacaatccacccgcctcaacctcccaaagtgctgcaattacatgtgtgagccaccgcgcccggtcggggttctatagattcttaatcatgattaaccagcaatatgataattcaatagatccctgctcacctcccctaaagaatgtgccactctaagtagttggttcaaaatagcttgactttttaacctctagatccactccagagaacagtggtctctccccattgcacaaacacattcatttatttaacagcatcacccaaagcataagaatgggaggaaacaatgaacgtccttcatttctccaactttaaattatcaaaactactgattttctgggctcacaaaaatgcagttgagttcagctgttgaaagtttggttaacatgtcagttgagccaccaaatggaataacagttgtaactctcttatgttttctctactgtcctcaaaggaatagcatgagaacaaagcaattagcatacattcaggagttgcataatgatgttttggacaatgacagactgcagataggacgagggtaccataagattataatggagctgaaaaatctctatggcctagtgacatacagctgtagtaacactgtagcacaatgcatttctcacatgtttttggtggtgctggtgtacaaacctactgtgttgccagttgtataaagtatagcacatacaattctgtacagtacataatagttgataatgataatagttgactatgttattggtttacatatttactataccatacttttcatcattattttagagtgtactttttctatttccaaaaaaaaaaaaagttaattgtaaaacagcctcaggcaggtccttcaagaaggattccaaaataaggcactgttatcgtaggagatgacagctccacacagattattgtccctgcagaccttccagtggcacagggacaagatgtagagatgaaaaacagtgatattgatgatcctgaccctgtgtagacctacgctaatgtatgtgtttgtgtcttagtttttaataaaaagtttagaaagttaaaaaaaaaatagaacaaagcttattgagtaaggatataaagaatgaaaatatttctgtacaactgaaccacatatttgtgtttcaagctaagtgagtacaaaagagtcaaaaagtttaaaaaattaataagtaaaaaaagttatagtaatctaatatgaatttactattgaagaaatgttttaataaatttagtgtaaatatacagtctttttttttttttttttgagatggagtctcgctgtgtcaccagactagagtgctgtggcgcaatctcagctcactgcaacctccaactccctggttcaagggattctcctccctccgcctcccaagtagctgggattacaggcatgcgccaccatgcccggctaatttttgtatttttagtagagatggggtttcactatgttggccaggatggtctcgatctcctgacctcgtgatccgcccacctcggcctcccaaagtgctgggattacaggcatgagccaccgcgcctggccaatatacagtgtttataagtctacagtagtagatagtgatgtcctaggctttcacattcactaaccactcactgattcacccagatccacagccactttccatcctgcaagctccattcatggtaagtgccttatacaggtgtacaggtgtatcatttttttcccttcttaataataataattattattattttgagatggggtctcgctctgtagcccaggctggagtgcagaggcatgatctcagctcacagcaacctttgcctcccaggttcaagcaattctcctgcctcagcctcctgagtagctgggactacaggtgcgtgccaccatgcctggctaattttttatatttttagtagagacgggatttcactgtgttagccaggatggtctccatctcctgacctcgtgatctgcccgcctcagcctcccaaagtgctgggattacaggtgtgagccaccgcacctggcctctactgcattattactatacctttcccacattttgatacataaaaaccattgtgttaagtgtcacaattgcctacagtattcagcctggtcacatgctgcacaggtttgtagcctaggagcacaggctacacttatagcctgtagcctacgtgtgcagccggctatgccatgtacatttgtgtaagtgctctttgtgatgtttgcacgatgaaatcatctaacaactcatttctcagaactgaccgggcatggtgatgcatgactgtgtagggaaatactttcacccctttagaagaagctataaataaccaggtataaatgcaggattcctttccaaagacaaatactggaaacaaacacaatcaaggaagataattgattacttcaaaaaaacaattgagatatgagagtaaattaaataagaagactgtgactaggataagtaaccaataacagcccataacagctaacattattattattgttgttattattatgagatgaggtattttgccaggttgcccaggctgacctcagatactgaggctcaagagatcctttgctttggcttcccgagaagctgaaactacaggcagctgccagcatgcctggtctgcaatttacatcttttgtacactacagcacgttactgttcaaagcacatacaagtattaagctgcttaatccttgcaacactaccaagaagtaggagttattatcatgactgactctcttctacagatgaggaaacgaggcacagggaagtgaaaggcgtggtgggacagggacctgcggtctggatctgcttcatatagagaaactgggttcttaagaaggaaaatgggccttaatttctaaatcgtaacaagttcagccctcactcctcttttttttttttttttcactatcctggaaaaaaaaaagaagtggatagaaaggtactaataacaatgagtttaatttctcaaattttattattctttaaaaaggatacattggtacaggagtaaagacaaaaaaaatcaaaaaagaatcgagtattcaaagacccttgatggtgtaacatcaattattttaattttgtttttaaaatttttattttctaaactcctataataattgtttttcaaatggggaaaaagaacgaagtttttattactgcctttctttctacaatatattattcaatggagatactgaacctgtatttgctacaggctaaagaaaataaaataaaacaatccctagccaggcaagggagattttcagagaggatgccaacagggtcctatcccatcaggcatccatgacaaatctgtctgctgtctggtcctgtagcatcacccaaatgtggttcaggcagcactggaaacaatacagactcaggagatcagggaagtcattttgcaaagaagcagaagtgtcaggaggtagcacctgtaaggatgaatgctggagctgtctcatggagtttcacagaaaggtaacaagctgcacaatgactgtctaggggcaacagatacataggaggaaagcagtcttcattcaaacaggatactgagattgacatagtgtgtcttccaacaagataagcaaaagtatgtgaagaaatgagtccctaaaggaaaatatctctttgggcaatttcacttcaattcaatttcatgttaaatacaaaatacatatattgaatatgtggataaaatcactagaatatattcgtgcaataacatctacgtgagacatgacagcatctcaccatgtctggcagtctctcggggtcaaatgcaatctctgccccccacctggcagtcatcggcacttatggaataggccaggcagaaggctctgttagatactgccttcttcccttcgcaatgcactgtcccagacttcctggggtgagagaagtgattgtctatgagagctagcttggagtgaatgaaaacagcatttaagaggctcagcattttctgatcgccaaagggggtacccttcaacatgaggtgacccagcaatgattggctgctgagttctttgagtattttagggacctgcaggagatctgggtggagctgtgggtttccgtgtgtacagtgtgtaaacatcaccctttggtgcttcgccagtgcttaaggggctcccaggtgctatttattttgtttagtttattgttcagtgttattgtttgttgacttgatctatttttttttctcctacaaaggggccagtctgcaaggacacatcctgtagatggctaattgatgatgccctattgtttagtgtgtgtgcactgtggttttatttgcttcggttcaaagggcctaaacaatgcattcgttggaatttagtaactgctgtaaaatcagcacagagaacaatctgtgagctgatattttttgtacccaaatctggtaatctctgcttgactaaagaaagcaaaatctaaaatgacctttcaactaaccatagaaaaggccttccattgaatctcaaagagacttatttttctaccaaatataaaaacattcgaattatgcatcattttccatgattcaaaggagacagaggtgcctacggggcatgttactcatagacaagtctattctagtctaatcacgtccccttaaaaatcaccgagtagatgacaccgaggatgagaacgaggtactgtaatcattactttagaaactttatatttttacctgtttcaagacagaattctcctagaaaatctggagcaacaagcttattccccttggagaggagataacgaataatggaccacgcattcggagagaggaagtttccactgggagcccttcctgcatcagtgcgtctctggttgggctggctatctgtgtaggaagtgaacgcaggaagtatctgtctacaaaccctttatcctcaaggtaattgctgtagcagcattttactgtttaccaaagcagtaaacatgtgatctaaaaaaagatgttttccatctccagaagaacaaggctttaaaaaatgtatacatgtgcttattttgtaaccagcttatcaaaattggttacaataggcttgggctttcaacagtgagtccatgaaaacagctcttgggatggacagaggtaccctcacagggatgcacaagaaacaaagaagtggcttccttcactagaatgctatcctagcaacacacattttatgtcttttctcctaagaccggcttaaccgagttcatactgtttggcttacaaagaaggtaaagtcaacaaaactatctatgttaattcaggttggtagaatgagtaattcacaaagtccaataactcataaaagtcacttacatttggccttggacaatattcttatttttacgtgactataaatatgcttccagtttaggagttcacacaagacaaagtgaaaagttagaactcaaaaggagatgtgtagtggctgcttttgctgacttttgcctggcgtaggccaagcctcctggtccgtcttttcctttgtttctttattccagatcaagcttgcaaacctgcaccgtcccagatttcctggggtaagagaagtgattgtctaggagaggcagcttggaatgaataaaaacaggtccaggaaggatccctcagcatttaagaggctcaggaggggtccccctcatcatccttgttgtcttttgtgtttttcaagccgccttccaggtggatagcgattgcaatgagagagaaagagtatggaaggagaataagaagaatagggagacacagaagttaacaacgccctgaatgtctccttccaggacctgctgtgcagtgtccggtgaactcaccagcaagcatttcccagccctgttttaagcaatctccaatgcagatcaggtgctcgtgaataattgggagctcactgtgtctgtcagagttcttactttataatgaagagataaaaacatgttcatcacaggaaaatggacaaattggctaattgaaaacaaaattcaattcacaaactgttgtagaaattgaaaaaaaaaaggtagggggaaatgcttttcatagattccctgattttagtcttagaagaaaaatgtatttggcttgaatgaatagtaaaattaactaactttgattgaggagcttatgtgtgccatatacagttctgggctcttgcgacttggtgaatctcactataaccctgtgaagtaggaactatcactctacccatttcaccgatggaaaagcctatctcctgtgaggctgtggcttgccaaaggtgaaatggccaggaagtagaacagccagggagtgaaccccaaaagccaggtgggagcccatttcccctgcccactgcacgagacccctccccggtttgaagatccgataggggcactgctgttagctccccctgcgtcctggcagcagcacagtcagcagatggtcactgtggagaaggcggagctgaccacctccattttcctataagggagctagggccaggagaggtgcgttcacctggggaagtcctgcagcatcaaactaaagctccgggccaccctctcccagatgggcctctttccacttccccttgccagcagctatatctatgcctcccatccgttgcacggaagataaggccaatcccttttccacagaggctattttaaggatgccacgaagaaatacagagtaccaagtgcctccctgggccaaagataaaagtgggctgtgctctctggattcaaccttcatgtttttgatgctctctggaaggtcagggaaggcacacatatcgtatggatccaaagaggactacgcaatgcaaaaccacatactttttttttctttttaacttggagcaatgtcttgggacatctacctcaaattgagacacaaactaattgtgttgacagattctaaagtgttgtttcaacagtttcttcttcctcaaaggtgagcatcatgtgcacactgtcaaaattaaaaaaaaaaaaaaaaagacccaataaaacccgatgaaacccaaagagcatggagatgagaaactcactgctggctgacgatctgaatgaatggccttggggggaatgtgaatgtggaggtagcagaagggtcctgtcttcagtgcttgattctgtatcaatacttggtaaatttaaaaaacaaaaaaaccagcaagggagattttaaatcatcaaggcagaaggatttaaaaagtggaatgtgttaaatgcaagagtgcgggatctttgcataaagttattatattttcaaaaattcgacaagcattgtttttaccaaacgtgtttaaagtaacagccctgaggttaatgttatgattggattctgatgtggcactttaaaaataaatcattttgcttggccttagcatttcttttcaaaatgtctctgtacttatctgtgtacaacagcagattaccgttcttcccagagtttaattccatgaacaccctgctgaaagacttgttaaggccttatggaaaactctgacctgcgtgttcattattgacgcccaagacgagtgcaaggaagttgatacttgggatgaggaaatttaaatcagcagctgatctggaatctggaagcactgccccttggatctcgccaaatatggaaagaattcttgtcactgagcaaatatagaattcagtgctagagttttacctcttgaattttctagaactttgttttgattagccacctagagtataagaattgctgcctatgggatttttcccagaagagtagataacataaagtaaccagcgataataattttcattatccaattatttcatgtgtctccataacacttaatacatcatgtttctctgcacagtaattcactatgtacagctagggtgaatagcaggaaaaaagagatcagatgataaagagaagggagacagatttgtgtgacttgtataagatacttcgcctctctaatcctttgtccttatctgtaagaaagcagcagtacccaggctgctgtgaggatcacatgagacattatgagagtttagcacaggacttggcacataacaagcagttattaggatgatgttagtttggattatgaattcaagatactacagctacattttttatactttcttaaacatcaatttaagtcaattttaattaacgttattttactaggagaaatgtctctaaaaacataagaattctatttgaagtctacaatgataattacattactctgatatcttaacttcctctttatgatttcaaataattaaaatttaagtttatgttttcaacaagtgcttattgaacctctactctttgccagtcactgttgaggacacagaagaaatggataagatatcactaaaaacagcttctgcgatatcagtgggtatacataaattattcacactcaacaacaaacacaagcaaagctgggagaatgtgctgacaggaaagaaaatgaagagtgggagagtggacagatgggaatcgatgtgaaattttataaaacatgtcttggccaagctcagtaggggaaatatgtggaaagtaagctagaccaaacagagaataaaagtataaataagaaaaaaaatccagaggtcacagtggaccactagccaaaatgggttcacagcaaacaaacaaaaaaatgtaatgaaatactaaaattaaagaagtacaaataaaaatgagattctgttcttatctgtcagaatggcaaagattcaaagagtaaaatattcagagttgttatgggtgtagtgtggaactggtctcatatgtggctagaaaaagggagaactggtataatccttccagagaataatctggtaattattttttaaattggcaaatatttaaatttggcaaagacttaaaaaatatatatacccattggctcaataattcctttctaggcaccaatactaataaaaagtattcaaaaaattaaatagatggtgtactgcaatataatgagtgaaacatcgcaagcagcatcactttatacactaggatattggttataaaatggtaatacatattttagatagaatataatgaaacaaaaattttgcttatcaaaaaatgttagtaacatgggaaaatgcttgtaaaacaatgctaactgagaagagcaggacaggtaggtagatacaaggccaaacagatacacacggtggagagacatatcccaattgttaggaatttgctgtggttggttaggatctgaacaatttatattgactttgtgatgacttttaaacgttttctctaccataagaattttttatgtttataatttatgctaaagaacaagatgtattttttgtaattcaggagtaaagaggagagtggggtattccagggtgctgttcctgccctaaccaggagcacgatgcagtcataggcctctgccctcctccagcagcctcggctcagaacaggacgaagccaaccctctctgaccagcaccacctcgggcgacccctggacgctccacctgcccctgtgtgtggtacctgccctgctacacctttaacaagcacccctgcaagctccctcctccttccttccctgtcctgtggctgcccagacccagatgtaccctgcctgggtgtgggaggccgcacatcagagcagtctatggctgtgggcttcacagctgaagctgggccgtgggaaatgttgagacgagtgagtgcagagcctgaaagacaatacggtagaaaaggttacatccgcgggggggcgtctgatggcatctgccatttattgaggatgggtgcgagacagggtagccattatgatcccattttacaggtgacgaaactgagatcagacaggctagctaccttgcccagggtcacaacaggaaggaagcaaatgcaagtgtgtctgcggccacgtaaggtgagagaagcgctatcaggggtggtctgacagaatccccaggccagggagcagttgtcctctatcctgtggggtcaaaggaggggacaagaaggctctccttgaggtagctccaaagaaaagaccccgccagagcacagtgtgctaccaaacgctggaacagcctggagactgtccctgtctcttctctgaggtttctcatttcagagaaactctcatccgtctggcttccccatggcccttactctgtgattctcttatgtatcagctgttaaaccaataaatccgccaaattgttgggatgcctataatggctttgggtctccactcccacagagggaatcttattctaaagttctaaatgtatcagtcatattttcctgaagacaacagaaatggttgtttcatttacttatttttatgtatgctttttcaagagttgttaacctgtgtttgtgtttaaataaagatctgttttgcaaaacaaaaactttatgagataatcacttataaacgtagataattaagaaatggttcaggctcagcacattgtctgagagcattgcagtcctgcactgtatttcatgggggaagaaaagcccacagatggagccattctcaatcctgctttccagggtcactgagtcagggtgcctggcatgcatgggtgcatgcacacacaggcagagggccagggagaactgtgctgtgtccacagagggcagcctggatcacagagctgaccaagaacggaagcagcaagttgttttaaagtagttgcctgtaaagccacttttcggcaaggacaaacactcagagcatgctctgaaatgacttatgcacagcagggcagcggcattttgcccctggccttccttccattctcccggaatccccctaaagtaacaaggactgacgcaattcgtatttcacttagccaacaggttgatgaaaaatcataaatctgtagctattaaactcattaatcacatccatcaaaattctgtgaggagttaactttcttcatataactcttagtcttaattaagtttccctcacatgtgatagcaaacgttcaagaagtgcaaatgtgcagacgtggcgtatataatgcaagctttatgtctttaaattaataaaattgagtcctatcaggtcgtgtttcaattaccatcaaaccttccaacctctgttaattcaaaaaaaagtaacttctttaggcaagtcatggaaatagcactagggtgccctcaggtctccaccaagccttgttagtaactttccatgtcctgtctgatttttaagatgctttcccctgatgctgctgccggctgctggctctctccacatccttcaatgtcagatctctgtgatgatggaaaatcccccacattccctttttacacattaagtatctttctaggatcagaacttgcaacctggggttcatgttctccttaaaaggtccggggagaggactgtatttctgttgtaattctatgtatttctttttaggcaccagaaagtattattctgagaaaggactgtaggcttcactagacttcccaaattgcagatggcattaaaaaaaaaggaatcaggaaagtctttgggaaattaggctaaaactcctaactgaagcacaatcgagttttcagtgcaacagcaggatccctgcagtctgtagcaaacactgagatgtttgtggggacagtggggccggtgaggttcagcacctctcaatattgtcagatgtcaccaatgcccaagggaagcaccaaaaccaatcagtgaattgtctgcaaaccatcagctttgttgcttccaagtctttactagaactcttaagctgatcttaaaattcacagacacttagagataaatgaacactctcacataagttcccaaaattcctttacttcttccaattgaaacattttgttcccaatttcaagttaccaagggaaaatgatggtaagaatcacaaagactggatacgaatatttagcttttcatagtgtctcatagggtcttacaaatgttaatgcaaaaaaataaaaactccactcaaatgcagaaaaccaacttaaaaaattcagagcatctgatacctaatcgactaattgatttatttactgaaacaacaaaaaaacagagtgcattgagactggaaattgcctctatggggggctgtttcctaattccagtggacagccatcattttccctatgctaacttgggctttgcgctaacgtaattgaaactgtagtcaacagactcaggacctcctttttccactctataaacaaggctgtaaaatcatctcattactttacccaggaaatctaacagaaacatgtcttaaaggaagtcacctataaagagggcctattttaacagaagattaaaaaaaaattcacctgtagtcattctaagggttcacttgggtacatacaataaacacataatgcaatgtaataaaatgttaaatcaagcatagtaccttagacaagtgtaaactattatttccaaaaaagtgttcagaaaatcacaaaatattcaaactttcaaaatagcttcatgtattcataaatgtatacttcaaattaaacagtataacacatttggatgttttgcaaaatgtacctaccttctaaaggatggtctgttatttcaatgtcctttttaatgcactgagttttttgggaaaaaaaaccacataagatcgtacccaagctattcaagatttacacagaatatttgatttaacatgcatatgaataaggatgaaaataagaacaaaaaaataacattttgggtcacaaaatcaagtaatttctattcatgtagctataagtagggcacattaactctcaattttataattcctgtctataggagccatatttcagcagattccaatccttgaagccaaagaaagaaaagtataaggtgaaagttcttggtacacagatttttaatatattattgaacacaccttgagaaataaaagctgaacttctcaaacacagtttctatggtacatatgagtcaaatcttctaatacaaacatttcaaattatgaaaataccaaaccaaagagtatttttgaaaatggcttggcccaattctgggcaaacttccattttcttatgcactttccaacaaactaaaagccttatgaaaacaccaccaaatgcttctcacctccgtgcagcaaaactaaagacatgcaacaaacacaattttcttttccctccactcagcatctgcttttgttgctgatttttcacatttctacaaatgtcacgaaggcatggtggcctttaaaacaactgaacggacccccattcaagactgcatgccccttgacttgtagtcaccattaaattggcttcatttccaggaatcaggccatatttaggattgtacctgtgcagatttacctccacattaatctctacatgctatctactaaaaacttaggcaaggaaatgcatcagaccaaacaccccacagcacagagaaccgaccggccattgctttccaatctccgcaaacctaaccattgctggaagaaatcttactcacagtgcacagacagtaggtattttattgaagataaacatatagtggaacaaaccaaattacccccatttgagttacgtgagcactcagttctcagcgtggatgtcccacaaatcaagtcaacatttgcgtcccattaccagcagccacttgccgagtatctcttcgcttccactgggactgcctggcatccctgatgctaaggagccactgaagagcctccaaatgtctgacattcacaaacgcatcttttgctttgacccgacccttcaacctctccgagtctgctgccttttctcagacacacatccaggcaccgttagggatagttagagaatctgaaaattcagaagcgctccgaaaagcctttccaaaagtaatccacagcactcaacagtgaatttagaaaccccaatttttttctgagtttgaagtttttaagccttgcggatggttggagtaggaaaaaggaaatttactaggcagtgcaaaggaaatcttgttgtcctctattgtggcagtgggggtgttgcccaaccctaacttatctgccttgataaaggaaaccaaagaaaagagtaacaagaacaagattttgtcaaattaaaaggaaccctttccttaccttaatagtgctggccataatgcgatcaagtttattgatcgttaataaatgttaataataattattgcttctctctgaccagaaagtagttttgatgaggttgtttagagcggatgagattgtgctaagtctgggaaatgaagtcagccaatggcaggaagaggtttctattggtcctggctgtccagcccaaagaaacaggatatttgggagtggagagataagagaccctgaaaacaatgttgtttttcttgatgatatgcagccaggagattttttttttttaattaaaaaaagaaaaggcatcaattgggatggggactgccacagcaggtgtgaccggtgtgccgccgtgtgacacactgcactgagaccaaggcaggatgcagatgtgatgggactccgcatggcttcacacgggctgcaagcaccttggagccaaggcgttgagggcaccccactgccctgggtgtcagcccttcgcagcccaattcttcgcagaattactaggacagaggacttgagctcctttctcctaaaaggaaactttgcaggtggagtttatttcatgttaatagatggccatgttcagtaacagccattgcctggctgatttttaacaacctatatttattcaacatttcatataagtgttccagaacagtttcattttctccttccaaatacctgcactttttatttgctctacaacaaagttgttgaaaacgcaaggactctaggcttacagtaaacacaaaaaataaagaggaaaaataaaccttcctaagtcttgttttcaagtatttattaaaacccaaataactgaagtgactacaaatgtcccggaatatcagtgagctggtctcactctgacagacatccatgttgcagacaacagatcctcatagaacttttggctacccagagatgccatgtgagggccccattacatgtctaaaatccaagctataagttcagggtcacaggtctgttttctcctcgaaggaagtacagcgaatgcaggcctgaacattccttagagggtttcaggactttaattactcattttcaggaaattgcttggaagaaacattttgctttgaatctagctacaggaacgcaggacccataaagaggtgtggtctcaataggcgaccccaagaacacaatagactaaatcctgagtcatctgacaattcctggttgcagagctggacgttcagtaaatggatttcactcagactttaggccggcatgtgtcagagttctgtccaccagcccaggtcattctggcttttattatatacctctgatttatcacctcatgttaggacaaaagaaggaggagaaggagaaagataaggggggaaagggagaggaaggagaggaggaggaggagggagggaagagggcgagaaaaaatggagaaggagaaaggaaggacagaagagagagagaaaggaaggaggatgggaggaaggagggaggaaggaaggagaaagggagggagggagggaaagaaagaaggaaaagaaaagaaagagagtatattgtaagaaaatcattctgtggaaatcagaacctaagttctcagcacctacattatgagggggtgttgatttccgctcttttcatctctgaacaatgaataagatggcaggctgattaaaattctgtttccccgaaaatttcaaagtcctgagctgttttatctgggcagcttccactagaattctggagtgcggaggagaaaagctctctcagcttccctgagtgtccttgctttttgttctctcctaagaagcatcaatgtaaaatgttaactgtggcctccacaacacatggcacctgattatgcctttaccaaacaccagctttaaataagatgaacgctttgctaatgaaatagccacggaagaaaatcctgtgtggtcccgcctcacccacgcctcgtggttgctaatccagccctcagttgttccctgcagcaggaaagatcagcatttctactgggacctaatgcttcagtgatgatttggccttaactccctggttcttgcctaatgcaaatcaaactgtgaagagtgggatttcttacctctctattttgaaataatttccaacttacagaaaagccacaagataatacaccaaactcctaataccctttgcctggttaactctgattgtctactggtgccaatgtacatcattttctctgctttctctcacacatgctctctctctctcaatctctgtctctctctcccatatttatttatgtataacatacatgcatgcatatatccatcattttctaactaataaaaatattgttttataagagacaaatttatttattggatactaaaaaagagaaaaacagatgctattatttgatcaatattcgatccataagttttactgcgtctaattttggaaatgcatacaaacataaaaagtgatctaataaaaagttaatttggggatactgagtggtaaattctgttccaaaattttacaaaggaaactcctcctcatttctaatgacaaaatgtttgattgattcctgttgtcttcaaagagaataattcttgatgtttcaaatggcatcatagcatccaagcctggtaatctctgactatttaatgtaaagtgttttaaaaaaatctttggctcttgataggacaaggcacatcttttttttttttttttttttttttgggacggaatcttgctgtcgcccaggctggagtgcagtggcgcgatctcggctcactgcaagctccgcctcccagcttcacgccattctcctgcctcagcctcccgagtagctgggactgcaggcgcccgccaccacacctggctaattttttttgtatttttagtagagacggggtttcaccatattagccaggatggtctcgatctcctgacttcatgatccacccgcctcagcctcccaaagtgctgggattaaagacgtgaaccaccacgcccggccaaggcacatctattaactagaatatagcagtgcagaaaccgtttcccaaatattatcctatggggaaattatctgaagatatagatatcactctagctttcctcacttgtaccccaagtctatgttattaaatggcctcatccctacaccacccagcagcctaagaaccaggctgcctttcccacctgatacctcctctccctagggaaatatgccctccaagccaccacgcggaccaagttagggggcaatctggcacacggcccctacctgaggcccgtcctgccatgagcctatcagggcagggtcctttttcactctccttgagatgcagtaatcaccacactagaccagcacagcccatacagtagctgtggacagcagaacctatgaataaagcacacatttcccttgcatgcttctctgccacaaacccatcccctgtgaatctgccaaaaccttccactagtctcctcacattttactccaaagaaagaaacaaaataatataacataaatataccataaattcactgtcacaataaaagaaacactagtatttatttatcctaaaatcatttcttcccattttctaaagatcgaacaagttctcattcttgttcccttactaacttctctgtatggaatatggggaggaaggttaggagctaagaacactctgaatgacagccacatggttctcaatgtaatacatgcgcagagcaaagagaggagatccgtctgaacctccacatctgtggggacacaacagaagattcactcatgactcattcacgtctttatccctgccctatacatccctacaatggaacgcccttcctcctcaaaaacattgcaggaaaatgatgtcgtagatgaacacttagcaatatggaaaactgctctgatattttacctggttagttaaaaaatcacagtatataggagaattatatccatagactcattttgttaaaaataaaaaggcagttggggatggccgtgcattctgttccaaagcatctgtgaacctgaggaatagacaccatgagcgaagctaaccttcccgagttgaaaaatgaaatgcaatggtggcagacatgtccaaggaatattatggggactcgatccctttatgaatcttgtcatagatgaatgtgtggagatgtcaactagttggcagcagaacagtattggaacggtggtaatacaaggaaatagtatcatcatattagaaactttggaatgagtataaataatggctgttcaacagaaaaacccatgtcccctctccaaagggcctgtttcactatatgtaaaaattaggtcatgtatgttttcatattagactttttgttaaataaccttttttttttttttttttgagtctcactctgtcgcccaggctggagtgcagtggcgtgatctcagctcactgcaagctccgcctcctgggctcatgccattctcctgcctcagcctcctgagtagctgggactacaggtgcccgccaccaccctggctaattttttgtatttttagtagagacaggttttcaccatgttggccaggatggtctcgatctcttgaccttgtgatccactcgcctcagcctcccaaagtgctgggattacaggcgtgagccaccacgcccggccaataaccttttgtaatagtcaaaaaataaaaaataaataaaaaggcaaagtaaaaatattgacagctatatcttataataccaatggcagagaagctttttgttttttcccctcttcttctttggttcacttatattttcaaaacataaatttgtaataaacataaattatatcctaatataaaaatatgtaagtaacatgcaatgttgttcatttttgtaaatatctgaaaaatacaggcatgttctgtaaaaagtgcagcccacaatacttgtaggtgtcaaaccttttagcatgcccaaatgcctgttcttttttaaatgtctacagcaagcatagagctctttttttttttcattttattaagaaaacccagaaacgctcaagagtttcgtggaggccatctatgcggcattaatccattcaggtgatattaatggccttttcctgccaggaactccagtgggcactcaggaagccaggattacagggctctatccagtcaccgcatgtctcggcattcgggaagcctatctcagtctcctcaaattctgcacacataaaacttcagagcctgggagcgacccatgaaacgcaggtttttaaggacaaaacaataggacaaaagtgctgtatattgtccttaagatgacacatgaatttaaaatgcatagtgtttggattattcatgagagccccgcaagaacgatgtcccaggggtttttgccaggaacatgcctgagattgtagataagaatcaagcatctggggctgccgcacaatggaaaactccagcactccatggaacttttccatctgcagcagtcggaggatttgcctgagaacatacgcggcatgaagacactctcagccctcaagggcacccagtcagcgctgtttaaggacggtttttctgttcacagcatacttcatgattacagcttcactccattggatacaactatgtgagtatgtgtgtatgagtgtgtgagtgtgtgtatgagggtgtgtgtgtgggggggtaggggagtgccatatcccccagcagcacattaagaaataatccaattacaatttaaataaccattgtttcaacactttctctaagtggtgaatgtattcttcagtctcttggttgatctgaactaatagaaaccaaggaaactgttatcacataccaaatcctcaacttctcaacaccaagttgcaatttccttaatactgaagcacacgtcagttcagttctataagctcccatggagcaatgatttcaataaacacaatttcataagcatcccacacgttctcaagtttaggccaattttgctcttactcaactccatatgactttaaaaatgcaggaatattaaaaccattatcaaggactccaaataggtcaatgtattatctgtggttttaagaaagaaacctaagaggagagtaattattttgtcaccattatttagcttaaaataacttttaaatgtattgttccaattattaggcttctccatataatttggaaaccattaaatgagtttcaacttctttgtccgtataactgggtatatctgagcatagatgctacagacatcacgttgccattggtgcccataaggcttcgtatgcccacagggcatataattaagattcacaaaagcatctgactggcatcccactctacccccgactcagatccaaagtatcctttcccaggtactgtcccctgtcaccatccttggccaaattgagaatttatcccaggttgttgaaattaattttgattttgattctagtcagagttttaaatgattttttaagaagtgtgtcaatctcacctataagatactaaacagcatcacttatttttgtcttaatctgtcactattttatgaattatttttaaagaaaatacagattacttcttaaagaaagatcataagtggcactataatagcattcaattgatagaaattgatgtagaagcctgcattaataatttttcctgctgctttctaaagttggcttttagttttcggttgaggtgggctttaattcagcatcacctcatttgatgatttatttactaatttatttccatcacaaatggaatcagaaatgaagcgaaggcaaaaaatctttgccacaaattcatttatatttgcatgagtatcaccaggctacctgcggatgcaatgaagccctatacccgtgcctgaagtcaggagcacaggacactgggagtctgtctcagcgcagtaactgctacatggtacgctccacatggtatcctctccacctgagccctcctcatccctcgccccctctccacacctcaccctctccacactgtattatctcccactgcaagcaacgcagaggacacagaggtgcagctgaagtgaaggcaggccagttcttttccaattcactcttatgaaaatgtgttaaatcccgttaaatgcaccgacctgaactgaaatgatgatatcagtaaatttgttgttgtcatctgatgcccacacagatctcagcacatgttttgggaaaggctgcagtgttcaaggagtactagaaatgttctttctgagtggactggccatgataagccaaagaatattatagccgatagggataaatcatggttttcccactgcgcggttgcctggtggagattattccagcctttatttacagctacaaaaataatcctgcctcaaggattttaggaagcaaccacctcctgcctaaagaactacactgcattgttgacttgccagctagaaaccagacatgagtcgtgcagggaagttccctttgaacggcttgaattgttgtcactagagggtgctaaatgcccctcaaaaaggcctttagagagaatactagtgtgcctaattcttgatttaaattccttgaattgacattattttacaaagtggtctcattttttacttgttaaaattaagatctaacatttataatgcagaaatggtgtttttttttgaaaaatttggattgttcattattatagaacataaagaaatacacgttttaggagcaaacatgaattacacagatctgaatataagattaaaggcataaatctgggggggtgagatttgtccatggaaattgtataattgttttatgccactgttaatgattttaaagcctgaaaaatttaccactttacaataattttagattgttcaatatgttcccaaatgtgagttgcatcaaattcggtaaatgtagagtatgtttgttttctctgtacacaatactgacgtcagtgctagtgcctgcctaaactcagacaccagtagatccttttccagaactaagtgttataggaggaatatggattatactgtaatatatcagatgtgaaaaaagcctcacggtcccttcctttctcaaaaaaaacgtgtagtattttggaatatgcatggagtatagcacttctaaaaatggtactttatgtatatatgaagtaaaataggccttaaaacttaatatacagatttccttgaaaataatcttattatacatttacactgactttttggtcatccaaacattatgcacttaagcaaaaagaaatataaccaattttgcaactttcctcttcctgcctttgcttctacttaaaaatatctgcagtatttccttttctcgccgcttccactttggttcatataccaaggaatcgtgaggtcaatgggtgacagttgtttgtctgtgttcacggctgtcgggcggggctgggtgtgggtaaggctctgaccgacatctgaagaggcttcacccactgcggtttaggatacattttcctctcgctctgccagtagaacagggaggctagttttcaatgtgttctacagaaggataattaaggcagtgtgtcacctgctcgtctgctatttttaaaaggaaacaaacataacctttgcatgtgagaggcattgcaaactagatgggaggaggcccggaccctgtaacagtcgtacattccggtcccagcttcgctggggtgcaactgcagataaaagacgctggctcgacaaaaagcgcccctgggctctgcattgccagcatgcacaatacgaattgctaatgatgagctggcttaggtaggaactgaggaccctgagtgcagggctaacctctgcttcacaggaggggtccactggcgcgcgctggaggcggggagccttcgtgatatttctccgaagggaagagtccatgcagcatcctgataacagggaccttggcttcatccccaactgctcggtgaccccgatgcgtcatttaattcatttgtgccaatattcctttttcaatcaaccagtaactttgcaggtttgttcaaagaagaaattaaaatgcattggagatggaaggcagccatcttcccggagccccagtgctgacactgggaggggaaccccaggattccctcatgactgtgtcagtgatggccctcaacaagcacttactgaatgagtgaatgaatgaatgaatgaatgaatgaagccggccacagagcccaggagtatcaggggagagcaatactggctgtgtcagtggctagtccaggagagcccttcaagagcccagagttcgacttgaacttgggactcccctgggatgggtgaggttctctcaacagcagttgacaggagggaactgggacaggcccagccagtttcattcagtccagccagctgtggctcctctttaggaatgtggccaggcccagctgtggccaaagcaccagccagtccctcagttctgaacagaacgtgcccagcatcagtgccttcatttgtttttaaactgcctgctgaccatccacaaagttaagatgacagctgggacttaagttgtgaggaaccagtggctcccccatcactctctctcacacacacgcacatgcacacacacagagacacacagacacacacacatgcacacacacagagacacacaaacacacatgcacacaaagacagacacatataaacacacatatacacacatgcacacacatatatacacacagacacacaggcaaacacagacacacaatggatggtatcgatatctatgaacagatgagagagagagacagagcaggaggtcatctgctccccacccctcttctccccactgtcaccacctctctcccaagtctagctgcaggccctgtgagctgtggaagtggcttttttaagctgtcttcttagattgagtcattgggcagtgaggaaggtaaattttctctaagaagcctcccaaatctgtatcttatgggatttccgtctcaataattgagctaatagtacctgtaagcaagtggatagtcaataaaaaaaaaataccggctgtaagaacgaatgaatgaatgagtggatgagtggatgagtatacatcctctattttgctggcatcatgattattttacagcagatttatctggatttcaatataaaataagagctcccatttgtatacaacttagtccttgtaattttccaaagtaactctgattaaaattatttccagccaaactatttaggcaactgggttggtttcacacgtacttatcagaaaccattagaatggtatattgattgcatttctagacatttgccataccaccatggcaactgtatttcccaagatggcccagtaggatgtcccatcatgcataaccttctataaagtgacattgactttgcttccatcagaaagtgaggtccacgttcccactccttgaatctgagttgggctgtgactacagcagaagttcagctatgtggcttccaaggctaccttggaaaggtgatagagcttccacctgattttcttgggaacagccactcttaaacctcagccaccatacggggagaaagcccaagccatgtgacgaggccatttgtaggtgttccagtcatcagtcccagcccacagccagcattaacccccagaggtataaatgaagaaaccaagatcactccagccccaaccggcacttgactgcaaacctataagagactccaagcaaataatatctatctcagcccaatcaagccctggaaccatgagagattctaaataataaagtgatcattgtgattttaagccactgagtcctgcagtgagttgttatatagcaaccgggcatcggcataccatcagaagattccttaagaagaaacttttgcaacgttgctacagcagaaaatattccttctgtatgatcattcatccattcatcaatcttgattggcattgcctatgtgctaagcattgtcggtcactggaggtgcagaaaagaagtgaagcagtattcagccaaacaaacaacttgcatattggatagagagaaaaatatgccaaaattacaacagtattttgacccaacagaaaggacataagaagggaacatcaacagttccttcctattcttttccaccctttttctttctaggctcattaaatgtagaggtgcctcagggtcactttgccccatgagagtagataccctcctctcccatccctaactttggtcttcactctatgcctgataccagcagctccccaggctcctccatgctgttggcaccccattcccattctctggaaacatctcagcccatcaacctcagattactttcccaaggagatgtgagaaaacttcaattttcccctttgtgacttgcagagaaataggggtggtaaatgagaagcagagggagagggtggggattcattaccttgagttactaaagagaaaagctctagtgtttagaaggtgctgttattattttctctgaaacattagctcctagaaatcagaggctctgtccctagcatggtctctaaggcttccaggacgccccaggggcttccctcagtcaattttgactctaatgagagccatctggaaggctgcaatggtgggcctggctgatcactggaggggccttcgctgtgggcacagggacgtgcacaggttcacagagtgtgtctccgtttctgggaaccatggtcctgtgtgctccttccccaaagaaagcaggagaaagaaaaaccacagtcctgagtgggattctccccaaacatctaaaaagcttctttaaagaagtcaagttatcataattaaactcacatatggaatgcctatagacaacgtgttgctcttccaatcccagggagctaggacacccaaaactcacctcccagacggagctaggatttgagatactggattccacattacttaaagctgttcgagcttttcatcaggaatggaaagcattaatgcgtctcacacgtcactctctgtttcatggaattcttacactggggagctctttttattttactatttttctttaacagccagaacactgagaagtttgcaaagaaatttttcagctgcctttagtgacccttaactcaagaggttttgcctaatctgtaaattggagttgaaaatatttcagtacttttggagtggggagctttttgtctttaaaagagtggaacgacactaacaatagggctatacataccttgtgcttctttgtcagttactgcaaaccaaaaccagatgtgaagtatcagcggctacctcgtagtgacccatggaagttgaggctaatccatatcattcttaataactcaaaactgccaccttttaaccacctaatttttttctcacttacaaatgcaaaaaaaggaattgacagtacacattgaaatcgattttcccctgaccacttacagattttctcctataagagccaggaataaaagctcactccattatatcaagcagccatcatctgagtatgctttagtttaggtgatcatcacctttaacaaaccaagatctggaaggaagatttctgatctttaacaaaccaagatttgaaaactagatattcctgtcatgaccttttcccaacattcagtatgtaagggattcactggattattagactgcttgtaaatgtaagaaaacatagaaggtttagtgtgaaggagttagcaacctaacaaatgtttccccctgaattttcaataaccttcctgaatttaaaggtaatgaatataaatgaagaacaaaatcaatagatataggaatgattcacaacctcccaaatgaataaatcaatcattccaccctacatttgaacattcaatcaatattttgtctatttactaaatctaagaggaactactttaacataaaactaaatatgaaattatttccagcattgaatattgtgttttgccttagagcaggcacaaagtggaatgcctatgggtacaaagctaggcattgattgatgtttaatacctacaaatacagcaattacactgtcatgctacacgagacttcctattcctacactgaaattagactgcacatatgtagggataaaagataagacacaatcatatcatatttcctcaaatctaagactttgggtggtaagatgtaaagcacatcatgatttaaagtatcactaggaaagaaaaaacaattctgccaatgaaaattcaccgtaatactttctaatcaatcaattttaagatacatcccaatttttaagcaagaataaatgtgttaaaattaacacaaattggtacacttgtgatacaacagaagcactaaaatgtcacagcaatagaccacagggtttctcaaccttggcagcatcaacattttgggttggttaattatctgttgtgggggctgccctgtgcatggcaggatgtttgctagcattcctggcctctacccactagatgccagtaacacctcgcagactccaattatgacaaccaaaactgtctttagacatggccaactgtccctaaaggtgcaaccaaaaactgtcccagttgagaaccactggaacagagcaattcggttttatcagccttgtaatataattgtgtgtgtgcactgtgtgcatgacagactgtcagcctaatggaaggtatattgtcagatgggatagattgacctgaaaaaatcacataaaccaacagctggtacatatacaagagtgtgtcctgcccatcctaacccacacaatgcaaaagaacctggatgaccacgagtcaccatcacaggagtttactatccataagtgtaaaccatccaagaaaagtgaaaacagattaaagaaaataaaaataaataaaccaccacacaatatttgggcctagccagataacaacaatgaaaaaatgtaatattttgaagtattggcaagaatgtggaggaaaaagcattgacattcgtgtataatgggaataaaataatttatcctttgtctccgcaattgatattctagaaatctattttttagaaatactcacaatagacagttataagtacaaaggatgtctgctattacactgctcagtaacagtaaaatatgaaaatacactgtacgtctttcaatcagatattgaataattatactacacagtattaagaatgagatagatattaatgtactgcatagaaaatattcaaagtataataagttttagaaaattatcacatatgtatattagcatatgcagagaaaacatcttaaaatacaaatttcagttttgaggtttggatcatggagtaactgcccccttttcaagtcaaacagttgagaaaatttaggataaaacaagtgtgtgctacctttgtaatcagataaagtattttaaaataattcacattataatatagaaatactgaaatgccaagaaaatttaaatatattaattaaaacctacgggccaggcgcagtggctcacgcctgtaatcccagcactttgggaggccgaggcaggcggatcatgaggtcaggagattgagaccaccctgggcaacatggtgaaaccctgtctctactaaaaatacaaaaattagctgggcatggtggcgtgtgcctgtaatcccagctactcaggaggctgaggcaggagaatcgcttgaaccagggagtcggagggtgccgtgagccaagatcatgccactgcactcgagcctgacaacagagtaagactccgtctcaaaaaaaaaaataataataataggctaccaattagactttatagaatacataaatatattaatatagctacaaagaggttgaagcttattcattgagacaagagtatttattgagcatcgactttattaaatacactgttagtaagataacaagtgaaacttgttaaaaaaaaagaaactaggacaaaagaaatttgagttgagttccccaaaaacagggaatattcagattgtaggggaaattgggtaaaggatttgtttcagcatgaaaggagcaaggagcaaagaaactaaatgggaggttatgctgagaagtatatcagtatgaggaaatatcttgacatctacagacaaatatttgttgccaattcattttgggcattgaggattcacaagaataattaaaaacacgtaatataaaatccttctgattagagcacattttatggcactgcataaagagatggctgtgggagtcatttatattttaatactaacttgaacaaggcttggttctgcaaataaaacagaagagtaaatatgaagtggagcacataataatgttactgtttctgtgggtgagcttccataggaaagaggcaaaggcatcaatctcaaaaagttagaaaaacccaaagaaagaagaagaaaaataacaaatgagaacaaaattgagaaaattgtaaataatatggtagagaagataaacaaaaccaaatctggttctctgaaaagattagttatgtgtaagtcactggtgattacagagagaaaagagggaaggttaaaataaccaaagtcaacaataaaaagggggctattactacagatgctgtagacattggaaggataatagaatattatgatcaatttcctatcaataaatgtgaaaaattagttgaaatacataattggaaaatataatttaccaaaactgtcaaaagaaaaaacacaaaacctgaactcctataattattaaagacattgattgaaaaatctcagacctcttaaaggacaactccaaaaataaaaaaataaaaaaaagaaagaaagttccaggccagacggatttatcagcaaattctaacatgcatttaaaaaaaaaaggatgccactcttacataagcttttcagataaaagaaaagaaagcttgataccaaaatgtagctagaaaattatttaaaaaggaaaattatgggtcaatttcatacataaacatagatgcaaaatcctaaataaaattctagaaaacaaaacccaacagtatatacgacaataatatatattgtgaacaaactggatttattttaagaatgaaagcttgtttcaatcaaataatcaaatttacattgtaaagaaaatttatataactttaaacaaaagaagaaaagcacttaataacattcaacattcatattaaaaattcttagtaaattagaaataaagaggaagtttataaatcctacaaattgataaaaggaatctaccgaaacctacagtaaaccacacattttcatgtcaaaactttaaaatttaatcatttgaagttgggggaaaagacaaagaagccccacatattaccgcatttgtctgaaattgaattggcagtcttagttagtaaagaaggcaaggaaatgaaatgcaatgttaaaggattgggaaaaagtaaataaaactttatttacagatgacatcatttttttacacagaatttccaagagaatttggaaataagtcattagaattaataaatgagttttaaaagtttgctagatacaaggtcaatatagaattttagttttatatatcagcataaacatcaatagaaatcaaaatttttaagtgatactgttttcattagcattaaaaataccttacaatatggacataaatctaacataatacgtgcagaacctctacaccaaaaactacaaaatattattaaaagaagaccaaaataaatggatagatatattcatggattgaaaaacttaataatcaaaggtagaattttcttcaaattgatcaatagattcaatgcagatgcattcaatatttcaacaaagtttttgtgaaacttgagtgattctaaaatatgtatggaaatgcagagtcaaaaacagacaagatgctcttaaagaagagtgagaaatacaaaagattatcagagactattacaaactggaaaacctagaggaaatggatacatttctgaacacatacaacctgccaagattgaatcagaaagaaactgaaaacttaaacagaccaataacaagtaataagattggataggaaaaaaaatctcccaacaaagaaaagtcaaggaccagatggtttcactactaattctaccaaacttagaaagaagaactaataccaatcctcaccaagccatttcaaaaaattaaagaggagagaattcttcctaattcattctatgaggccaacattaccctcataacaaaatcagacaagaacacaacaaaaaagaaaactacaggctgatattcctgatgaacatcacttcagttcagcatggatacaggccaatatttctggtgaatataagttttctagtattttgttcagcaaaagctatcaacaaaatattagtagcctgaaaccaacagcacatcaaaaagataatgcaccatggtcaagtgggatgtatcccagagatgcaaggatggttcaacatacacaaatcaataaatatgatacatcacatcaatagaaaaaaacaaaaaccatatgatcatatcaataaatgcagaaaaggcatctgataaaacttaacattgtttcatagtaaaagctctcaacaaactaggtacagaagaaacatacctcaatatattaaagtccatacatgattaacccacagctaacattatactgaacggggaaaggcggaaagtctctcctctaagaactggaacaagacaaggattctcatttttatcacttctattcaatataggactggaagtcttagccagagcaatcaggcaagagaaagcaataaaggtcatccaaactggaaaagaagtcaaattgtccctctttggagatgacatgatcttacatctagaaaaacctacagactccaccaaaaaactcttaggtttaattaaaaaattcagtaaagttgcaggatacaaaaaaatcagtagcatttatatacccaataatgcactggctgagaaagaaatcaagaagaaaatcccatttacaataggtataaggaaaaaatatctaggaaaaaaattaaccaaggaagcgaaaaatctctacaaaaaaactacaaaacactaatgaaagaaatggaaaaggacacaaacaaatgaaaagacactgcatggtcatggatcagaagaactaatatcattaaaatgaccacaccacccaaataaatctacagattcaatgcaatccctgttaaaatattaacgtcatttttcacaagaatagaaaaaaacaatcctaaaatttatatgaaagcaaaaaggagcctgaatagctaaaggaaccctgaacaaaaacaacaaaactgggagcatcacataacctgacttcaaaatatattacaaggctctagtaaccaaaagagcatgatactagtataaaaacagacgcatagaccaatggaacagaattgataacccagaaataaatccacatattcacagccaaccgactttcaacaaaggcatcagtaacatacattgggaaaaagacaccctcttcaataaatggtgctggaataattggatatccatatgcgaaagaataaaactggacctctatctcttgccatatataaaaatcaactcaaggtagatgaaagacttaaacttaagaccccaaattataaaactattaaaagaaaatagagaaaacatttcaggacattgatctaagcaaagatttgatggctaagacctcaaaagcacaggcaagagaaaacagacaaatgagactatattaaactaaaacacttctgcacagcaaaggaaagaaaacaaccagcagagtgaagagacaacctgttgaatgggataaaatatttgtaaactgttcatctagtaagagaaaatccagaatatacacaaaactcaaacaactcaacaattaaaaagaaaacttttacaaagtgggcaaagaacgtcaatagacatttctcaaaagaagacacaggaatggccatcaagcatatgaaaaaaaatactcaatatcactaatcatcagggaaatgcaaatcaaaaccacaatgagatatcatcataccttagttagaatggcaattattaaaaagacaaaaaataacagatgctggccagaatgcagagaaaagggaactcttctacactgtgagtgggaatgtaaattagtacagccactatagaaaacagtagagatttctcaaaaaactaaaaataagactcaatataatccagatatctcactactgggtatttatctaatgaaaaagaaatcagtatatcaaaaagatacttgcacccacatgtttaccgcagcactatttaccatagcaaagacatgaaatcaacctaaatgtccatccacagatgaaatggtaaacaaaatgtggtacatatacacaatggaatactatttggccataaaaataaggaaatcatgtcacttgcagcaacatggatggaaccggaggtcattatgtcaagtaaaataagccaagcacaaaggacaaataccacatgttctcactcctatgtgggagctaaaaatgttaatgtcatggagatagagagtggaatgatggttaccagaggctgagcagagagtgggagtggagaggaagagagtttggataatgggtacaaacatacagttagatagaaggaataagttctgatgttgtatagcagagtagctgactatacttaacaaaaatgtattgtatagttcaaatcagctagaaaagaggacttgcaatgttcctgacacatagaaatgagaaatacccaaggtgacagacaccccaaaaccctgacttgatcattacacattctatgcatgtaacaaactatcacatgtaccccataactatgtgtgtgtgtgtatctatctatctatctatctatctatctatctatctatctatctatctatctatttatagtatccatttttaaaaggcaaatcttaaaaaaaagagtgaggtaggacaacctgctctactaaacatttttataaaggcacagcaattaggtcagaatagtgttcatgcaggtagaaacaaatcagacaatggaaaagaaaggaaagttcagaaacagattcacacatatatggacacacttgatttttgacgaaggtggcagttgatttttttttacaaaggggcagagtagttaaaaaagggagaaactgttggtaaatgatgctggaaaatgagaaatccacatgagaaacagaaacttgagaagtaactcataacatcacaaaaattgatgtcagataaactataaatctaaatatgacaagcaaaaactatgaagtttctggaacataatatagaaaactatattcctgacttgggaagggaaagattttaaaaacaaggcacagaaacactaagagtaaaggaaagactaataaattgaactgcattaaaataagaaaaaaattaggaacttaaattttcatcaaaagacactattaagagaatcaaaaggcaatgcatggagtggaagatgatatctttaacacatctaatctactattcatatccagaatatgtaaagaacccccatcaatcaataagaatacacacaagtcagaatacacacaaggaaaaacagggaagaaactgcacaggcagtcataaaagaggatatccaactgctcattaaaaggtcttctacttcattagtaaagcaggaagtacaaattaaaacctgaatgaaataacaccacagatacatcagaatgtctaaaacaaagactaacaatgttggtgaagatgtggagcaataagaactctcacacacagctggagtttaaaaaacatccttatttatccatcagggctgtaataagaggcatatagcatattcaaataggtaagtgaacaaaatttaatgaaagaatttacaacggtaaaggtagaatttagtaaaaaccaaagggtgaggaagtcccccaggctagcaagaacaggaagccattactaccctcaggcctacaagggcaagggaggtagcagtcacgcagcaccggtagctgtgaacacaggagaggataaacaataggagctgtggccttccatggagggaaaaagtcactgccaacccatgaccaaagagagaaagctggagaaaaaaactccccaagctctctcctcctactctcaggcttccttgtggtgactctcatttgcttaacccaacagaagatagaggacaaaggagcccatttgatgtagtcgacagaagtcaaactcccaggacaagaggagcagagaaggatggagaatgaattagagaagtaaacaaagaaagtcggcacatctactgtcatcaaagactgtgtaattccactatttaatacatgtacaatagagatgtgtgtatatgtgcaccagaagtcacctacaagaatgtccactgcagtattattctctcagttaaatgctatatctggctgcacaactagattaggactgagaccctaaccacacatgtagaagcagggagaaagatgcagttgagaagccctttgccatctgatatgcttccaaacaagggaaactcagcttggacactgaaagcattttgtataaaatactgtttgtatgatatccccatgtcaccacacacacacacatacagacacacacacatacacacacacacaacaaaaacaaaaaaaacttccagggttacttttctcctcagttagcaggtcaaaacttttcacgtgtgaaatacttttgcaaggaggcagatgaaacgggggagaagggataaccttgccttgcagtcatctatcaattcactgcaaggaaggaacacagagcttagatatgaagcatcaggagttcttcccaagacccttcttgtcccttgggaagagccaggagctggaggggatggccttcactgagaagtggcatcaaattagaacctgcacaacaaataggaaccagctacttaaagatccagagaagtagccctctagactgaaggatcagctcctcaaatatcctttttgattttgaactcacaagttcaggggcatccgaggaacagacacaagccagggctgaacaatctcatctgtgtccatgaggtgggcaagagccagatcctactgaggagtttgaacttaatcccaaacatggcgggaagccattggggccaaagatgaattagggattgtctgatctccttgacacgttctgaaggttttgtgtacagaaaaggtttgtcaacatgcacaaaggaaagctgggataaccaagctaagacgctaccgcatcattctaggggacgggtgactcattccaggagtttctgcaggaagacctatcaggactggtgattgactggaggcagagagcacgaaaaaagaacaatcagagatgatctgtggtttgtggttgttgtgtaatgttaaggcttaacaactgcgaaaatagtgtttttactttacagagaagaagacttgaagaatacaagattggggagagcagatcgggatttgtactttatatcagacgtgctcatagatatacatgttgagatatcagttgggagctggatatatcaggattcgagactgggaatcaccagtttatagatggtttttaagccatgtgattggatctcatttcttagtggggagaagtgagataacaaataaaagccaagattaaagctgaaccttcagcctgcccatcacttagaagcccagcagggacagaagagccagccgacagcacagagtcgaggaggaggatttccgggcttcagtgagtgtgcatcagagattcatggacacaacttaaagtaagaccagccacacagttcccttcattttctcaagcaacattcagcatctcaaagtgcggctactacacacggagccaagccctggtccagttatcacaaaaccttactagatatgtcgattattagctgcattttatagctaaaggtaggcaggcacagagaagttacgtctcttgcccacagtcacagcaagcaaacagacctcagaccaaagtctttctaactccttatttcacatctaaaacactatgtgacgccacctccaaaaaatgtgggggttactctaggacaaaagaagctcatgaaagcaaagagagaagcatagagcttaaatttagaacaatattcagggtgattgggaaaaatagcctccatacaaatataatcggttcatcaccaggtgaataaaatgagagaggaacctggtacaagtgaagttcattgaatttgcttgcaaaaaaacataattcaagtgtggaagtttggaaactaaaatagtaatcagctaaagaaattttcaggccaacttagacacaatggtgacaaagctcccctgaggagacaggaactatactacttgcaactctaactgaatggacttaacttagcaattaagatcaccgtaagtttgatcagataagtattaaagggtgtcttgggtacatttgcagattcagacactcttagttgtgaaattcttcaccaaaaatttgcaacttatggcttgcacattaaaaacatgatatgaatgaaattcagatatctcttggtaaattttataattattcctcccatcagctaaagttctcagtatgaagggttataactgatgtcatatacaataactacaagctgtatcatacaaaaattgagaattttctattatagaaagagttgctttaatctaaacctaaagtagcatcaataatttttcgtaagtggtccccttcctatgagtaagcccccaggaaaaataaattgcttttaagaaatgctgtaagtaagctgtttcatatataagttttgacaagatctggctacttaaattacaagatataaaatgagatttgtactttttctcaaatgtaaaaaaaaagatttacttctgaaataatggtctttataaaatatgcatttttgttcctttttcttatcatatctataaatttactaataaaagattctatcttgatttactaacatttgaaaagattgattatattggtattgcaagaagaggataccataaattaaaaatccatatattaaccatattcttttatttgcaatatgacaaatgattgtgtaaagttataatcaataaaagctatttgaaagtcataaaatggatattgccataactgctttcctagcaaggttaaaacactttaactatttttaatcaacttacagtgtagtagatcaagcatatctaaatattttattttaatcaagcaaatatatttctgctgttcctatgacagtatgaaagtttggttcaaaatatttccaaggtatttaacacagttcagtagaggtcctgtctcataaatcaatttcagattagataaaaggaaaaagcaaattcttgtttacttcagaatttttcaagccagttccaaagacagagttgttactctcatgtgaattttcagtagaaagctgaacaacgacgttgctctgacaatctttttaaataccatatgatggagacagaataacaaaaacaaagtaggtataagctgtacgaaattatttctcttggacataaaatatgtttggggaagaaatgcattgttccatatggactagggtagttacttctcaaagtgggagcaactcagactctgaaaaatggtttctcaaaggaggcattgtgtctgggtgaggccagttttctagtcaaaatcattttattaaatgccattggattgaatgcttccaggtttgctctctgaaatatgccctatcattcttaaaaaacacacttaggtagcaaaaagggcacactaaaaataacgtgggttaatgtttctatcctgcctgtgttttctaagtagcccctgcctgagctttcgacttttttaaatgaaccatcaaatagttggttgtctatcacaaataagccatctattttgttattcctgtaactttttgtagaatccagaaagtaacattcttgctgatatatcttatataacaccaagtccattttccaaatgaggattccaatgagtattcatcaccaacatctccccgaaaaatatttagaaaaaacagactcaatcctttatccaaagtcagtgagtaagaggcgggggccagggttggacaaaaatctctttggccaggaagccggtggtcaccctgatctacttctctaagctcccacccctgatgaatgttcaatatctgagtttcaccccactcattattgtaattctccgtaaaaccccagttacccacacggaattctcatctacatctagcccaatttgctactggatttcaatgttatttcatatgaaaacaatcactaacagaaagaacctggatctggtttcgaaaacataatttgaaaggaattcattctgaaggctgcaaaagcccagtgatggcccatcggtaccctgaatgggcttctcaggtgcctccactctcctccgtatgtctccatccatctcagaatacatgtctggctcttcctgctcataaacagaaacagagagttccgggatccaaaggcaagactgcgatttaagagacactttgtttttgtaggtgttcaaggatttggaatcaaagcagcagaattattaaaattaatccaattttcttgcatttattttgttagttcatacctctaaaagatatattttggaaggcacccttcaacccacccatttacaaatcaaagctttctttggaatccctgagaccaaacccaagctagacagtgacacactgccagctccagagccctgcccacctggaaggggtatggaatgcactatttgacttgagctcacatttaattacagtgtcaaaaatcaaacttaaattgctttaatcagctgccaacactatgagcctttctggcttgaatttctataaacaaagaataaattcaaatctgtcacaaagtggcagcaacttgttgaccactggactaggaatcgttatgcaaccatggctcactgtggaaaaagtcaacatcttcctatatgtgactcttttctgatcttttcggactattagtcaacagaatcatcataaagctaaattatctatctgcactgaaattactcagcctcagacatccaaaccagtagctgttcaccaatgaaacctgaataaagctgttgctgactttccctgcttcaatttagagtatttttggaaacatcattgcatgtttaaaatataataagcaaaaggacctttggtaattaaacattctgtaatttaaaactccaagagacaggagcagtgataagatattagattttctttactggggtgaaaaagacagaaagtggttaactgtttaaaaaaagaaagaaagaaagaaatccaaggatttttagagccagaaacagtaacagtgtcctttattctggaaatgtttaaaagcctgtaagcagagatcacccagttcatcctgagcattggtgagcaaataacttctgaaatgctcttgaaagagaattctccagccttctctgtttgaaatacttcctaaagcaaacacaaaagtgggcaaaacacaagagctcatgttaattccaaacaaagagaccaacagtcgcaaattgagagtccatcttagaagcgggtgctgcttccacatcaagcaactattggaaagagtaggggtagatgcagaattaagatcatttgtgactacagaaagagacaagaaaattaatttttaaaactaaaagagaaatttatttcagataatccaaggaaatgagcagagtcaacctaacaggattctcaagcccctccctactggtgtggtgtgaagatcacacgtggtgtagctgacacccctcacatcttccccgcgcccctcctgccacctctttttggcattcaccctctctcgggttctgtatccctgcccatgttctccatgaaaggccatgttaatgcccatgctctttcctgcctctaacagacgatgccttccacagtcactcaagctttaaccctcttctggattcggacctgtacatccaaaagcctgccagacatctcttccagatgctctcagagcacatgaccagaagcacgcgcaaagctctcctgagcctcagtgctttccctccaacacttcttccactctctcagttaccgagccaagacacagagttgcttgtgagtcatttctctacctcatcccccacccaaccttcctgcgagatcctgctcacgttacctcctaaatgctgttacgtgacttcaaccacgtcagctttttatgggggaggagaggcacctgcatatctgtgggagcaccaacctctagacatctcctgccaagttactgcaatgtgcagaaaagaggaagaaagcaagcccaagtcgcaaagtctttgccagtccttctaccaaccacaccttcggtggagatgtgggtctgtggaaatgcagagacggactgaaagccaaatgggccaatgagagctctgaacaaaacattaagcttgtttttctttaaggcaatacgattaacagtggtccattaagaatccgtttaaaaaaaataataataatactttttctgactattgttggggaagaataactcctttatggggagtatgaactcaaagacatgatattgtaaaggaggccttgaagaagagagggactaagaaatgtgatggcgtggtctgttacatgtgcaggtgctgtgtgtgagggaagcactgaggaccactggaggatgagggatgctctgtccttctcgggtatggctgaaggacagggattgcccatcaaggagtaaataatccatgagtggactaaattctttagaaacaggaactcaaatccagtagggattaggataaaaatgtaaactctaatttgcacctctccctctctcccctaagtagtccgtttctataattttatactaaatcaattaaatgtatctgctataatattaatcataattttgtctgaagtagtaacaactggaaactacctaaaagagtcagagcaggactgtaagactatattgtagtctacactatgtcacagcggactgcatcatgatagagaacgatactcatgatttaactgataaacacatatggcaatgaataaaactgtgagtaagatgtctttaattttagcaaaattatcttcattctaattttcaagtaaacttaaagatttatatataaatgcacataatttaattaaaatacatgcatatattaactagaaggctaatcccccaaaatgtccatagatgttatttctgagtgaggagggtcaggaaggttttaattttctttgtactaactctatttactaaaatgtccacctggattaacgttataataaaaatgttaccgtttaaaataaaatgaataaaatacaccggtatgaaggtattattagaacatacgaaagtacaaaatcaagcagcaaaaggaggaaattatattaagaactgaaaaaactatgttgagaattctgtctaagaaacgctgtagcaattaagaaaaatcccagttctgcaagtaatgggagaaagatgatgacttccagaactttcaccatctactaagatgttcaccaattcctaagaagggactgaatacgtctgcatcctcagatctgagagtaattttccacgacgcatactgagcaccataatgagtgaagtctctgagatgacctctctgacctctctaaaacaatcaggcactgcaaacatggcctatcccacactagcccttggtgaaattcaagggcataatattagactgaaacagtgagaagaagattcgacatggagtgcggcaagaatgtgttctagtccttgaaggccagcgctattccaagtgtggtctcagaccagcagcctcagctgcagctgggggcttggaaatggaaacgtatgtgctacgtcctggacctgtggaatcagaatctctgaggtggaccaggaatctgtgtttttaaaaccctgtggttggtaacttcctgctggctgaggacagagagaatgcttagtgaacgctgaggaatgacgggttaaataatccctgaatgattcctgagcggatcaatttctcagccagagttttgaccgcagctgatgatgaacagggctgtgaccaccaggaagggtctgaagaggaggcgttgattgcagttttctgcctctgatcctcaggcatggagccccaccccccaactctcttacacggaggccaaagaaaaagctggaattctccaggagagcaggacctgttaaacagcaaagggcaacccaaaattgtatgagtggccttgccctgagaagctttgaagccagaggttactgaacaactaccctggttaaaaccctaacgtgacaatgataacatgtgactgtatgtggctgtcttcaaaacagcaatgatttaggcacaactgtggatctcagattgttccgtgagtttggtctgataagattgtatgcgtttcccaggggtgccataacaaagtgccacaccctgggcggcttccgccaccgaaatgtattttctcacagctctgaggtcgaaagtccaagatcaaggtgtcagcagggctggttccttttgaggctgtgagggaggatctgttctaggctctctctcccccagcttctgggggctgctgcagtctttggtgttccttggcttatagaagcatcatcccaatctctgcttttgcgttcacatggccttctcctcatatacctgtctgtctccaaatttcctcttctcataaggacaccaagcactggattaggggcccaccctactacatctgcaataaccctatttccaaataaggtcacattttgagggaccagctaaatacaaaacattagccaggcatggtggtgggcacctgtagttccagctactcaggagaatcacttgaacctggattagaacttcacaattactgacacgattcaacccatattaggttgtttagtattatacattaggaagccatagcaaacttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcccatagcaaacttttgtaaacataactatttattaaaatttggtataattaatatttaaatatcctttctggcaagatttagccagttttttaagcttcattgagagaaccacaatattagcattaataatagaatggtctattaattttttaaaaagatactatgtctgcatttccaatataaaattcacagcaatgattcaggtagaaattaaatgaggatgtcattgtcaaccttttaaattatattacaggagcagggagcacacgggccctgaggtagaaatgaataaggaatattctagaaccaccaagaagccagtgtggccacagcagagtgagccagtggtgctggaggcaggtgagatcttgaagggccttggcaacatgaacaggagcttggattttatccacattgccgagggaagtatgaggtggtgtttagcagggcataaatctcatctgatctgtactttgaggaaaacactctgacttctgtgtggagaacagtctataggaagccaagaggagaggcagggagatgagggaggggtgacttcagtctccaggagaatgagctagtgatgtgaattaaggtgctggtggtggaggaagtgaggtggagaactggacactgggatctattttgaagagggagcctacagaacttgttggtggatggctatgagggaaagaggattaaagaatgatgctaggcatttgggcttaaacaaacccctgagtaaatggttatcctattattaatactaagatgggtaatgctagggaaggagtagccttggggagcagtgatgagttattttcttagagagaagccacgttacctataggaggctcaacagagtatcaaattagaataaaatatctaatgttctgatttgtgtctttattttttccattaagatacacatggctggccaggcgcggtggctcatgcctgtaatcccagcactttgggaggctgaggcaggccgatcacctgaggtcaggagtttgagaccagcctggccaacgtggtgttaccccgtctgtattaaaaatacaaaatattagccaggcatggtggtgggcacctgtagttccagctactcaggaggctgaggtaggagaatcacttgaacccaggaggcagaagttgcagtgaaccgagatcacgccattgcactccagcctgggtgacaagagcgaaactccgtctcaaaaataaaaataaacaaaaaccatgggaaagaacaattgaggaaactggggacttgtcctggaacagaagacacgaggacttttggttttttagttttgtttttgtttttgagacagagtcttgctctgttgcctgagctggagtgcaatggtgcgaactcagctcactgcaacctccgcctcctgtattcaagtgattctcccacctttgcctcctgagtagctgagactataggcgcacaccaccatgcccagctaatttttgcatttttagtagagagagggtttcatcgtgttggccaggctgtcctcaaactcctgacctcaagtgatccacccgcctcggcctcccaaagtgccgggattgcagaagtgagccactgcgtccagcaagaatgaggtttgaagggaggcatgattgtgttctcttcaaatagttgaaaggttccatttgaaaaagggatttacttattcctatggttctagtaagttgcagagggtggatctaagaccattgggtgaactttacagagaggccagaaagccttctccaggggaagaaagtcaagaaaaggtctcaaaactgtctggcagaattctgcacaggagagtcctcaattcggtgtagaattggcaagtataataactgtaaatccctctcaatctaccatctacatcattaggcgacatcttcatttcctgaaaattccaacacatgaaggctcacttactatcaagatgagcaagtttgtgctacatagtgaatttgatttcaataggactcattttataccttttaagagtctttaaaacgttgaaaatgtaaagatctgcaagagcaactgatcttcaaagtcccgtcgagtcacaggattttgtaatgatgtctaaagaggaaaattcccatttcagaaaaggctcaatagtatttaatagttagctcaaaaggacgaataaagttctacatgggaagctgctgaactacagtcaggccaaaccttcatactcggagaagatgactgggcctgtagacacagatattgatgataaatcatcacaaaccacagctttccttaattggggtggtgggcagggagagcaggcttcaggttggccttcctccagcaagggcacacacacaaaggggacctgaacacgtggagcttatggtcaggaagcctgaagtgcctgacccagcacatctggtgactagtagtgtagattccccacagaaggaatgacaaggcgtcattattcaaagtgaccttccctccattggaataatcagaaacagctcacaaataaagtaatctgtaagatgcttcatcttctctaggtaacctctccccaacatgatgacatcacttcacatgaggcgacatggttttgtgaggacttttctttccttccaagtttggaatctggctgaaggctaaaatcaccatttacagtgtttgagccctccttcacactttgaagaagggtctgtgtaaatagccattcctacttctcagactcgccagaggcaaaacctgttttgctttggtagtacacgctcttccttaactggtaaaagactttaaaaaaaaataagatgccatttttaattgtttcataaatctggcttagatatattaaggaaattgctattttatatgtagaacagcggcaagcaaatctcaagagattaaaaatcatgttcttgtggttttcttttagaagctgcaaatttgaattcaatttaaaaaatcatggcacagggacaaaataagaatgaacaaagatgggaaaaatgtccgcagcattctgcagagtcaagcgctgctgtgagtgagtgtgcatgtttccaattacacatcagggcttggcgagctccaggagtcaaattcagacagaacccaagtgcagtgcgttacacagaacccaggccaggaaaagcttcacagagtctttctttcaactgaggcaattgtgtagacaatttggttcatttcaagaaaaaaataaaactgacagaagaaagaaaaatattattatattttgcctctcaaaacaaagtcaaattgtgttggtgtataaatcaagattcagtatttccttggctgcttccagaataatagtagatcacaaagagaataagaacaagaaagttcagttctcagccagacgatccaaggtaacaaagggtgagaccctcattccgttactcacaggagcaaacagacaaccaataataattgggcacatgggggtttcaacaagataaactgttatgtgagtccagggtgctaatttctggattcttttgagttgcaaggaaaatatataccgattccccacccccacccacccacataacaagacacaatagttaacagctggaagactgtggttagggggaaatgtgattgtaggcttccatttcaaatgatggaaaatcatttctgaagtcactacgaaagttacttcacaaaactaaaagaagccttgacaccttgtgttatcccatcatctaaagcaattctagtttggaaacacttgattcttggcaggggattctaaagaaggtgccgtatgtgaaaggctggtgtgtcagaaggagctttaaggaactggaatgagaacagccaaaagctaagatttctgattataatcacaggtctggatgtgttcaaggtaaaaagagatcatccccatcatttgcaatattttcaagagaatggggctttagtgacactgatcaaagtctgacatggattttcagctgccttccaactccacatacctgcaattcaatgatctctatggatagtagaagtaactgccaccctgatgttctcatcggtgatttatacgtgaagtggactcaaaagaaatacaacgaaatcccttaataaaaattatgtccattgacccaacaagcttcccagtgctgtatcagttctcaaccgattttagagacatttggtcaaaaatgatctacttgtaataagccatctgagggcactagctctttttcacctctgtgttccttgaagcaggaagtcagtaaaatcactattgaattaaaatgaagtaaagcactttgagatttcagatttctaaattaaggaacacacaacatacggtactttatttgcacaagaattattagaacccagggctaacacccaaatgaggtcacaggtaaatgaaaatctgtctcagttatttgaactcaggtcaacacacagacagagcaaagcaccagctgacctctgatgcacaacccagtgttcttaccatagaattccagaaggcatctcagtcattctcttatgtaaatacaaagacgacaactggtttaaaaattcatttatttttattttagcttctttgtgtcaaactcaaagaagcctcacataaatgatcaaagactttttggtggatcttccaaacgtacatgccgggaaggcctgcttgcactttttccttcaatcctctaaaatgaaggttttgaagatgcttgccaatggaacgttgtgccttacagctataatattttttaaaaggcattcagtttaaattaatatatttggccagacaactgtattaaaattcttgttgttttttctgttataatggtagcctgtggtatgactagtcttcttcaaaaatatgtacagttattgcttctctcttgcctggggtatatcatgtgtttttcatttgagtgtacattgcaatacctcattaaaaccaacacttaggctacacaaaagtcttcatatcatgccgcaaagggcgtaaactaacgtggaaagtttcagagcctcataactcattgcatatacctcttatactagctgctcaactgatatttagctctcctggatgatgtcacagtttttatcctcttaaaatagcctgccttcagaaaatatatagtttccttcatgcactaatcatggggagttacgatgtaaatagagccattttttttcttatacaaggaacaagtgctctcaccctcctcccttctctccctccccatacacagaagcacacttcacttcacttatactaaacacttcacttatacttacactgcaacaaagagttgcaaatacatgcaaataaagcctttataactcccctctctcctgctggacagctccttgactcaagtatttccgaagacagacactctgataagggtctgctctgagcttcattctcagcatacagtcctgggattatttacctaccaatattcacctctgcatgaaccagtaagtcattactgacaagaaaaaaacaatttgtgattttttttaatgtcacaatttttctttttaaggtttgggagagaaagttgttttgaatgtttcatcagtttctattgccaaatgaacacctgtttcagagtccctgaaagtcacacatcagaagcttctgacttcaacatatagtctgctttgaagaattattttaaaaaagcattgactgcttgaagataagcaagtgacactcaatagcttcattctttagtcttagaaaataatttttacacttcacacctattaggatggctactatgaaatataaaaaaaattaaaaataacaatggtggcaaaaatatgaagaaattagaacccttgtgcactgctggtgggaatatcaaatgatacagcctctatggaaaacagtatggtggctcctcaaaaaattaaaaatagaattaccatatgatccagcaattctacttctgggtatatattcaaaaaaatttaaagcaggatctcaaagagttctttgtacagccatgttcatggcagcattactcacaatagccaaaaggtcaaagcaacccaatcgtccatccacagatgaatgaataaacaaaatgtggcatacaataaaatgtcattcagtctttaaaaagaagaaaatttggacacattgtacaatatagatgaatctttttttaaattaaagtggtttttttaatcgttttattttaaagttccgagggacatgtgcaggatgtgcaggtgtgttacataggtaaacgtgtgccatggtggtttgctgcacctatcaacccatcacctaggtattaagcccagtatgtattagctattttccctaaggctctcccacccccaccatcccccaacatacaccatagatgaatcttaaggacattatgctgcgtgaaataaaccagtcacaaaaagacaaacagtgtatgattctacttatgtgaggtacctagagtagtccaagttcagaaagtagtaataatggttgccaaaaggtgggagcatgcagaacacggggagtgttgattgacatcaagtttctgttttgcaaggtaaagaagttccagagatttgctgcaccaacaatgtgaatatacttaacactactgaactgtaaagtggttgtgactacagattttatgttttatgtgtttgccacaaccaaaaataaagattaaattaaaaaataaaagattttatagcacctatcacttaccaaacccactgtacatcttacactcgtgaatattttatgattttcaaaacacctttatttttttcccttatttgttcattccttcatgtataacccacaatgtgttaggttatgtgctgggcagcctggaagacccaaagacgaattagggaagtaccctatatttaaagccttgcaaggacataaatatcagtaatataaagtaaaatatgttcactgctgaaaactgctatacttcctagatttttcaattcaattgcaatttctaatattttgccatgttgatcccacaaattcacttgtgtttaaaagttaacgtgcttgattatcatacagctgcttctttcataagaggaatacagataaaacgctatgggatttcagggggagaaagaacttcttattaaattcatattttcaaccaataagaaaacacaattttttttaatcaacactatcttcttggtgcttttttcacatctcatcctctttcctcctttaccctgcctaagcaaccatttctggacccaatcttgggttattacatctgacggcaagtgttatgtgggccatggaccatgagcaattagccccctctctactcctagggatggagtacatgtgatgatttccatcagactcagattaaatatcttgctggtaagttacccctaaaaatcgattaatggactctccaggtagacactgaggtaatctccaaccaaacctgacttatacttaggggctttggaagcccaccagagtcatcaagccatatctccacctaggctctatactggaaagctggtcagtagtaacacaaagaacaagccatttgggaaaacagcccacatgaaaagaactgtggtttcaagaagagtcattccatcccaggtttaaaatactcttctcctctttatctaccttgaggactcctatctatccttccataccagatccagcctcatcttctaagtgaagccctcctctgggacgtcagcgtctcctctgcatcccctagcattttatgcatcctctgttaaagcaactgtttgcacagctgtatccaccactaaacttagaggcaacagaccatggttttgaatgtgtagaacccaacacagagcccgagacctagtgggtattcagtgcatgttgaagggaagaatgaatgcatgagcaaacaagacaatggaagtctgtcatcagtatttacatttcaaaatgcaaagtgaaaattgtgcaaatctctaatcaagctgtactttaaaatgctaaattgatttggctaaaaatatttcaacactgaaatttctttttgcaagttaagtcttcgcataaccaaaacagaaaagaacgtatcaatgaactaaatagataaatttatggctgacaaaatctcaagatttagtgtgtgagaggaaagtaaaattcaatgtgtccttgaaagttctggggtctaagatatacaggccaatggaatagaatagagacttcagaaataaactattgcatatatggtctgataacttttgaaagtggttcaaagatcatttaatgagaaaaaaaggagtcttttcaacaactggtgttgggaaaactgggtatacatatgcaaaagaaaaaagttgggctcttaccttatactatatacaaaaattaactcaaaatagaacaaagaccaaaaaataaaagctaaaactctaaaattcttatgagaaaactctaaaatgcttagggaataacttcataacactggatttcacaagcctgtcttgaatatgacaccaaaagcacaggcaacataaataaaagagacaaatttgcctgcactaaaattaaacacttttgtgagtcaaacaagctatcaacaaagtcaaaagacatcctataaaataagagaaaatatctgaaaataatttatctaataagggattaatatccagaaaaaaaaatatatatatatatgtatataacctacaactcaacaacaacaacaaaaacaacccaatttaaaaatgggcaaaggacttgaacagaattttttccaaagataacactaatggccaataagtacatgaaattatgctcaacatcactaatcattgggaaaatgcaactcaaatccacaatgaaatacttcgtagccattagtatgactattaccaaaaaatcagaaaattacaagtgctggtggagatatggaaaagttgcaaatcttatgcactggtggtgggagagtaaaatgggaaagtcactataaaaaacagtctagtgattcaaaaattaaaaatagaattaacatatgattcaccaattccgcatgaagatagcaggaaattgaactgatatttgcacatccatgttcatagcagcattatttacaataaccaaaaggtggaggcaacccaagtgtccatccacagatgagtggataaacaaaatgtgatatacacatatcatgggatatcttcagccttagaaaaggagagaaattctgacatatgctataacacagatggacctttggaaagttaagagattgtcttatttatcttacgctaagagaaataagccatccacaaaaggacaaatgctgtacgattccacttgtgtgagttacctagggcagtcaaattcacagaaacagaaagtaaaatgatggtttccaggggctgagagaagggtagaatggaaagctattgtttaatgggttggagtgtcagtgtaagaaaatgaaaaaagttctggagatggatgatggtgagttttgcaccacaatgtgaatgtatttaataccactcaactgtacactaaaaaatggttaggatgataaattttatgtatattttactataacaaaaagtcataaaaatcaaacatggttcttctcattaaaaaaaaaagaagattcctgggtctagttggttctccctccttcttagttcttggatcaaggagatagaattgtgtccaaagtgaccaagtgacctacggagtaatgggcttccatctagccactccctgctttatgactgagctgcactgggagaggcattgtcaggggaaattccaggtttctagaattggtatctagccagaatttgtcccagggctaagtggctaaggcagtgaactagtctgtcagcttctctgttttaaatggagtcatgtaattccattacataccctttgctttcaactatatggccaaacatgactggccagcaggctgggggacagaagacatgtgggcttgtgcttgttacctggaattgaaaagagctcttggcatggttcttgttcaagctccatggttgactagcacatgaccaccaagagagctactgtacttctccgagactcattttctcttctgtaaaaaatgactgagtttctttcacagtgcataaatcttttcctccaggaacagagactgcccagggcctgtccaagacaactaggaaaccagagcagcagttaagccattcctgggcaggaataaatgagcagatgtcagctctcagaatctcagttttctcactcataaaatggaaaagaatactatttcttttatgtcattcaccatattgtgagctgaaggcactttaacgatgctgaggctgtaaactaatgcataatgtgatgtttatcattcttcacctatgttttagttactgagcatctcctgacaccagagaggacgcaacaaaaatcacaactcctagaactgcacagtctaaatggcaaccactagcccctgtgacaactgatcacttgaaaagtgagtagtccaaattaagatgtgctgtaggtgcaaaatatatgctggatttggaagatgttctatgaaaaaagtatctcattagtcatttttatattgattacatattaaaaagattccattttggctatgctggactcttcagatatatcctgggagattgtattaaaagaaaatacatgatggaaattagtgtaggtagttactagaaaatgtaaaattacatgattcacatcctatgttcactgttctagacatataaatataactttgagttatttttaagcatgagaagacagaaatcgacgaataaagtgaaaaagctaaagattaaagatacttacaaatcattgttgtattttttaagaggtcattttgagcatattccttaccattgaagcccctgcctgtctggctcctctgcccaccttgttttgctaatgggtcatgctcctatatgtgcatagacgaggagcggctctcagggactgaccgtaagcatagtcagcacagcacgtatacccatgctctgaccccaggttggcgtcttggagggtgaagcattttcccagtccttctttgactcatcacagaggtataaaacagcgtctccaacacgtgatttttttttttttttttttttgagacagagtcttgctctgtcgcccaggctggagtacagtggcacgatcttggctcactgcaacctccaactcccaggttcaatcaattctcctacctcagcctcccaagtagctgaaattacaggcacacaccaccacgcctggctaatttttgtattttagtagatacggggtttcacaatgttggccaggctggtctcaaactcccgacctcaagtgatccacccatcttggcctcccaaagtgctgggattacaggctgagccactgtgccagttaaaagaaaaaaaatattcaaacatatttggtttcttattgaggtgaagttcacataacatgaaactaacagttttaaagtgaacaattcagtagcatttaattaacaatgttgtccaaccaacacctctgtctagttccaaacatttttgtcaccccaaaaggaaaccacgtgctcagaaggcagtcactccacatcacccctcttcctagtcctatgctttgcacacaactgactcaccctgacagttataacctaaaagttaaataaaattattagtaaactgcaaacccctggcaagtgaattacttaatatctcttaaaatcctgacatcaaatgattcccctgtgaggccatgagatgataagaacatccacctccctctcttgctccagtggaatgaaaccccctcctcaaggagggttacactcaggcataggcccgatcactcatcatatattgacagatgtgcaggcctgagaccccgccttctggagctttctaatgctccttgtttctcaatccaatccttgctaggaattaggctcttctgctgaatgtaaaatttttccatctgcctccataaagtatgtgccacctgtcagctgactggtcaaccccaagctcaaagtatatggacattttgggggtgacaatggtgggcatacatctttagcaaagattaagaaggtaccagaggaggaccagcacaacccagcaatgcagcagaatccatcaggaaagctttggctctgggtggagctccttgctttagctctgcctttgagcgcttgggtggctggggaggcactggggtggaagggaaggaagcaggaattcgtgtgctgcaaatttcactacacttgaccacaacttggagtggaaagggcactgtggtacgtctatctggccttcctttacaagccttaaaatgctgtggaatccatctggatggaagacgccatccaattataaatccttaggatactttttattgccctttaagagttccgatgcttgctcttccatgcccatatgtttctgcttaagaggcttcattcaaatcaaattggaagagaagtccagattacccaactacaattacctgagcaaaaatcccctcaattatcttggtaatccagataaattcggagtacaaaggtgagttgcctggatagcactggctaagaactgctttgtctcccatttcaccttgcattattataatctacttgattacacttcatttataacaatagggagggcttgttttatgccacacattgccacttgctcaagtgtaaaataaaccttaaatgactgatgtactgctaaatttatctcaaaaaacaatcataacaggaatcttaaggcaataaagtcaaacaaatagaattttacagaatttaaaaattattttgtgagtgatttatgctaaaatacctcaaatttatttcaaaaacagtcttacttaaaactgacttaaaatatatgtaggataaataatttgtagtgaatttaacgaaacttcagcaattcaaatgaatgcacattattcttcttaaaaacagatatcctgaaaatatccatcaggataaatagctaatgcatgtgtggcctaatatctaggtgatgggttgataggtgcagggaaccaccatggcacatgtttacctgtgtaacaaacctgcacatccggcacatatatcctggaacgtaaaattaaattaaatttttaaaaagcagatatttggaaagtaccaatagcttcaaagtaaaaatactctacactgtttttgtttgtttgtttattttcgtttttgtttttcttttttgagatggagtctcgctctgttgcccaggctggagtgcagtggcgtgttctcagcttaccacaacctctgcctcctgggttcaagtgattctcctgacttggccgtgccaccatgcccagctaatttttttacatttttggtagagatgatggggtttcactgtgttggccaggctggtctcgaactcctgacctcgtgatccacccgcctcagcctcccaaagtgctgggattacaggcgtgagtcaccgcgcctggcctatgcactgttaattttatcacgacagttataaatccatcaagatgtcctgtgatttttcaacacaaattactcaaattatgaacttctctgtgtgtattttccactggcttgtttatgaatcctgctgatatgtctgctacaatttctccaaaggctaaaagatgtttacaggacaaatgacatcatgaccatgtcaggcttaaatgtgtttatatcagttgggtttagagggtcttcaaaacatggctttaaaatctcagttattatggagcttaatgtgttcctgatgtttctggagtaatgtatttctaaaaatagagaaatagattggttaaaagaaaatgaattgttggtctaatctgtcttatgcatggctaacgaaatgcattttcactctcttccgtgataatacgacacttaaaactgtgaggaccaatggggtgataagagacaaaataaacagtaaatagatactccatgtgagttactactctgtaatagatagaaaagatattttatagaaaagggaaaatacccacagacatataagcaatgtcctgtggttgctatcaaatttactgttagctgtttaaaactgccttaaaggttttttaaatgtgtcttttctaccatagattctttagacgacagccatcaagcagcaaatacctcgcaggaggccattgtgtttctatttgaacttctatggatgtcaagctctgttcttcaaaatttagccctacagatgggtggcccaccggagagaattaatctcactatgcagccaacactaccctttctggatctttccccagtagtgtggattctgctctagtccagaattatgcagaataagtatacttcatcttagacaccataattcttcaaatatctaaaatgtatattatgctctccaaatcctggtcatctccaggttaagtatctctcaaaaacagtccatcagataatatgattttaaatctttatccccttggtcatatacccacaatctcattctatttaccaatatccctactgatgcataaactacatatgtatatgtgtgtttttttttaaaaaaaaagcaattccactgtaattttagcagaggttatttccacatagagctatgtatatgtgtatatacacatatctttatattatatagttttctgtgctttcccagttatctacaatgggcatatatgacttttatagccaggtaattcaatattcattcattcagtgaacatcattgagcatccactatgggctgggaagtgaggatggagccacaaacaagcaaaataaaaacccctgctcttgtggagttcccttctcattggaagagacgtacagtaaagaaaaaaataaaagagtaaagttaatagcctgtgagaaggggatataaaagtgggaaggaagacagggtgatgtgtgagaaacactttttttttttttttttcagatgaagtctcactctgttgcccaggctggagggcagtggctcgatctcagctcactgcaacctccacctcctggtttcaagcagttctcctgcctcagcctcccaagtagctgggacttcaggcatgcaccaccatgcctagctaatttttatatttttagtagagacaggatttcaccatgttggccaggctggtcgtctcaaacttctgacctcaagtgatctgcctgccttgacctccgaaagtgctgggactacagcaatgagctgccaagcccggcctggggaacactattgaatagtgtggtcagggaaggctttactgtgaaggtgatgaagacccaaagaaagtgaggaactaagtcataaatgatgggtagaacattccggattgcgggagcagcaagtgcaaaggccctggggtgaggaataccaagaatgtttgtgtgggcagagcagaaagaaccaagggtaaagcattaggagatgaggctgaagaagtaaccgggatcaggtggttagggccctcaggccctggaggaaggctggcagcgctggagccacatggactgacaatgtctagcagtcatcccggctccctgtgaagaacagaccctcgcttgcagagaagcgaggacaattaggaaagcagagtcatgatccacgcacaggatcacggtgacttggaccagaaagagagcagtggagctggggagtgactcttttcagtatttctcaggtggtaccagtgggatctgcagagaatacatagttaaaggaaatgtctggaactaaacatgactcttcaaacgtgatcctactgtggcagaagagaggcgactttacatttcctttcccaggatatcttattctaatgaacacagaaaccgtaaaatcaagccaaccaacatgatgaaaatgattatataaggtacacagcccaggctggatttgaactgatgagggaaaaaaaatctctagtgaaaattcctctctctaaccacagccttctctccttccatctctgcctcacccttgctctttctgaagccttcctggatgctcatgaagctctctccttctttgactcatcctattttcccaggacctttatcaactcagggctcttctcccctccccacagtcagctcactgtgctctgactagttccctgaaattgctcatcctcttactaaccaggaagcttctacccgctcttggtcttctttctccaccccagtgccaaagaactaagcactgatggagaaaaagcatgcggctaatactgtctgtctctaccacaaatctcataatttttaaaatccatttggaatttacattcactccttaacttcttttcattcactcctaattcacttcctatataattctctacacagctgctgaaaaccttcctttctgctgcctcttaccccaaaactactctcacattactcacaaaggttgaccttgttttctatatacttttttagagtaacgaagccataaaatgtaagttctttcaacctggacctcccactcttgggatttctcaatagcttcacctgtattctcccccttcactcttgactcagaggtaaacgctcccttgctcccaaatcctttagcaacgtagggttgataattgctcctttccaaatttaatccctgcatctgcgcccctgagacagacactgccatgatttcccagcttgctgtcttctccctcctgcatctcctccctttctctgtgacggatattttccctgtgcaagagaaatttcttctgccctaaaataaataatccaaaacatctcttgactccacttaagctaacattcaatatctcactttcccttgtattaacaaaagttaattgagtcagtacggtgctacaattctcagacacaacgataaacatgatagagaccatcaacatgccttggcattttgcctgctttctcttcaattacttgcaacttggcttctactgagctccactgaaaaagctttcatgacatgaccacatccaatcccaaagaaactgtccccttgcccagtggtcttcaaaaccctccaactccacagtgtctcattaactccaactcatttcctactaaacatctcttctcagctcttcaaagtcaaagattgcgaaccaaatctacagacttctcctctcttctcctttgggtccaactccatccttctccatgaaacttcttattcctagaaatggtgtctgcaccttttaggcttccaggcttgagcctagagtcatctttaactctttccatacccagactcccaagacccagtcagctgtttaggtgtctcctctgtatgcagcacttactgtcattgccctggtccatctcccagagcccacatcttgtcccactgtctgcaaagcctttcctatatgctggatataagtgcaaactccccctaaaatcccattgaagtttttacttttttctatcttctttttttacttctttttatcttcctctactcacacagaagtgctccaattatgaggaccttattttattccctttactgtcaaacacaaagccaacatgccatacgaaaagatagtactgtgcttccttcagtgccactctagcacgcccactccagcacacccttcttgtgcgggtgtatgctcatgtgatactatcacaggcaacacttactatgcaatacgttttccacaatcacaatatttccacaatattgtgatatgagctcattcttcaggccttgacacaagcgcccacaaacctaagagaatgcattttcatttttatgatacacagttttcgactgctccactctggctgccaaggcattcctcctccaaatcacgatgtctatatcaaaagaagaacaatgagggagagctggaggtagcgctaagaaacaacctggtccagctcccaggtctcatagagaacactcagaacacgcttgttagaggtatctgctcctggcctcagcttctcagaagcaattacacatcttctgggtaaacgtggagtgtgcagcacagaataccaaagctgagcttcccattgtacctggttgttgatctcctcgttgacctccctcagctgaatatttcttaagaacagtgttcaattaatccaactatccctggtggctggcaggatgaatcagttatgacttatttcatgtttgtgggtgggtgtatgaagtggtcctcaaaggagatttttgctctctgcagacagtctgcctgtctgtaggtcacttcctgccatttcctttgagtgggaatatgagccagggtgttggaagaaggaagagtccaaaagatgtctcagggaatgtcccatagccattggcctggtctgccctagataacttctgagccaggtcaccctaaagtgctacatgaaaagtcatggattttttttctaacttgttgatctcaaatgtcgtgatttggcatgaatatctagcttcccatgttgcagctatggatttattcttgccaaaatattggggattgggctggagagggaagaaggtacgaagatgcattctgtgttgctcaacaagatctgcatggcctcaaccaatgcgtgtttgaccatatggatatttacaaaccccaccatcaactcaccaaaatgaagagtgtcttagacttattctcacaagacaagagggaacgctgcctctaaggagtctctctgggacacctgggagagatttatttaatggtaaagcaaggaaaggaaaagatgaacagtgacctgcaaatcattaaagagggcgactcgatcataggcaagggcttttattagtgctaaaattccacttcaaagtttgctgattcatggatgctttttgttttgctgtttatgttgtagaaactgatttgattttcatagacaaaataactaggcatttataaccacatataggtatgaaagaaagataaaatgatgcccttagcccagtcagaaatactcttaaccatcaaaatagttccctgaatctaataggccaacaatattccaacaccagaacctttgctaccatagccagaatttttaagactgcaccactgttaagtagaggcaatttttaatacttagggtctaaccacaaggcataaaatgcaaaaaaaattacataatcctgtactttttaataattaaatgaaaatacatagactctaagcaggaaaatatctgagatccttaaaacggtataatcataattgttctacattggtaatatgtgtgatgatatttttctccaaaaaaaattctctaccatttcattctctttaatttcttctagcccgtaaggtctagcaaagaggaatacctgaaaagatgcaaattgtacccctgtgctgttcaatgacagcaaaaattgcagctccccaaccccacctcttatgtcccctgagcaatctgtgatcacttgagggtgaggacagtatattgccccaataaactggctttccaccaagtaccaccaagaaatcaaaacagcttttattttattgtgtcatcatatataagttaatagttcataattagttcaaaatttaaaattatgttctaaaaataaagctttctaagtcaatgtaggcaacgattccaagatccttatagttttcctctcttaaacagagaccattatcatatgatttttttttttttttgagacggaagctcactctgttgcccaggctggagtgcagtggtgcgatctctgctcactgcaagctctgcctcctgggttcacgccattctcctgcctcagcctcccaagtagctgggactagaggcacccgccaccacgcccggctaatttttttttttttttttttttttgcatttttagtaaagaccacgtttgaccgtgttagccaggatggtctcgatctcctgacctcatgatctgccagccttaacctcccaaagtgctgagattacaggcgtgagccaccgtgcctggccagtcatatgatttctaaagagaaactgaacagttatttgtagaaactctgcaaagcatgactttgggacgggcacagtggctcacgcctgtaatcccagcactttgggaggctgaggcgggcagatcacgaggtcgggagatcgagaccatcctggctaacatggtgaaaccccgcctctactaaaaaaatacaaaaaaattagccaggcatggtggtgggcgcctgtagtcccagctacttgggaggctgaggcaggagaatggcgtgaacccaggaggcggagcttgcagtgagccaagatcgcaccaccgcactccagcctgggcaacagagcaagactctgtctcaaaaaacaaaacaaaacaacaaaacaaaacaaaacaaaaaagccatgcccaagcccacccctgaccagtgaaatctccgggattggggcacaggtataatgtttttataaacatcttcctagatgtttcctgcatccagggtgataaatcatcatactaaaggcatcatctgaaggctcctagagtatagagaagttcagaataaggaccccaaactattgcacatcctgacactaactagctgtagctgtgcaccctggacagggagagatctaaacagctagttatcttacttcaccgaaatctacaactaaagatgtctatccacgtgttatagctttggcttccctaatctagatgttcaatctacttttctgcaatttggcaaagtaaaacacacatatacagtaatgcacaatgtcctgattgttggggtttattatttgttttgcatttacgcttcttaggtatgtaacatgccaaagtcatgggagctgagtcttttgaaacagaggcttctttgggtgcaaatattaattttctatgaaaaaaagagaaagtacaaagaaaagaaaaaacagcagtaatacagaaatgaatatcttccttgtctaggacacagtgttttttttaacctagatttctttgaacacagactgacacaaaaattaaatactattgctccattggagaggtgcaaacctggggcggtgagagtgaggggaagcgagtgagattgtcactacactagcttctggggacatggagacagccagtcactgagcccctgccttcccttggccatgcagatgcctctgataggttacacggaaaaattctacctcacagcagcccatggggtggaggaaaaataggaacttagttgcctacattcttcctgcatccccttcctcattggtcagagtcaccctgcatgtctgggttgtcacctgctcccaaggtgaccactccaaaagtcaggttctacgcccggtggtggggtgcttcatccaagtacagaaatgccaagaggatccggaaaccttttgacctggttgctgagtcacaggaaagaagggccagccctcctgggacaggtaacaggctggccctgagctgtggaagccctcacacccagaaggagtcaatctgctggggtggccactgagaccaagcaggagctgagggtcctggagtaatagatggaggcccatgagatgtgttcagacacatagtgtgtttgtcaactgcaatgtgtgtgtgcccccaaaattcatgggtttaaatccttacccccaaggtagcagtatgaggaggaggggcctttggaaggtgactaggtcataaggatggaggtctcatgaattgcattagtacctttacaaaagggaccccagggagattccctcacccttttgtcacagtgtgaagacccagcaagaagatggacatctatgaatcaggaagagagccctcaccagaacccaaccctgctacactctgatctcagacttccagcctttagaactgtgagaaataagtttctgttgtttatatgccactcaatgtatagcactttgttacagcagcccaagctaagacagcctattatgtatgagcaggtggctttgagataattgagaaaacagagactataactacaaccagccagagatgggatcattgcaaatgggactcgggttcacacaaggtttgtgacacacacacaaaaaaacataaggcagataaatcagcaagggtagcagtcaggaattgacagacgattaatggattgaggaaacagaatagataatttaaaagcaaacctttgtacacaaaagaattcaggaggtgataaaagtaacattttcatatcagttggaaagtaagttattcaatagcaacagaacaatcatttattgaggaaaaataactatttctttcctggttcaatcttggggtgttgtatgtttccataaatttatccctttttttctgggttttctaatttttgtgcacagaaatgttttttaatagtctctgaggttttttttttatttctgtgggttcagtggtaatgtcccctttgtcatttctgattatgcttatttggatcttctctcttttttctttatcagtctagctagttgtctatcaatcttatttattctttcaaaaaaccaacttttatttttgttggtcttttgcatggtttttttgtatctcaatttcattcagttcagccccgattttggttatttcttttcttctgctagcagtaagtttggtttgctcttgttttttctagttcctccaggtgtgacattaggctgttaatttaagatctttccaactttttgatatcagtgtttagtgctataaactttcctgttaacattgctttaactgtatcccagagattctggtatggtgtatctttgttttcatttgtttcaaataatttattgatttctgtcttagtttcattgtttacccaaaagtcattcaggagcaggttgttcaatttccatgattttgagagatattcttagcattgattttatttttaccgtgctgtggtctgaaagtacggctagtatgatttcagggttttttttcatttgttgcaaattgttttatagccaagtgcgtagtcaattttgaagtatgtgccacgtgtaggtgaaaagaatgcatattgtgtcgttgttgggtgcagtgttctggagatgtctgttaggtccatttggtcaagtgtcaagtttaggtctcaaatatgttaagttagttttctgccttgatgatctatctaatactgtcagtgagatgttgaaatctcccactattattgtatggttatctaagtctctcactaggtccctaaaacttgatttatgaatctgagtgctccagcattgggtgcatacatatctagaacagttaagtcttcttgttgaattggaccctttatcattatataatgcccttctttgtcttttttgatcattgttggtttaaagtctgaaattgaaacgctgaacagaccaataacgaattacaaaattaaatcagtaatataaagactaccaaccagaaaaagccctagaccagagagattcacaaccaaattctaccagatgtataacaaagagctactaccaatcctactgaaactattacaaaagatttaggaggaaagactcctccttaacctcattttatgaggccagtatcattttgatacagaaacctggcagagacacaataagaaaagaaacttcaggccaatattcatgatgaacagggatttggaaatcctcaacaaaataccagtaaaccaaatccagtaccacatcaaaaagctaatccaccatgattaactacacattattcctgggatgcaaggttggctcaacatatgcagatcaataaatgtgattcatcccataaacagaactaaacacaaaaaccacatgatcatctcaatagctgcagaaaagacttccaataaaattcaacatcctttcatgtttaaaacactgacaaactaggcattgaaagaacatacctcaaaatactaacagccatctatgacaaacccacagcaacactgtactgaacaggaaaagctggaagcattccccatgagaattgaaacaagctaaggatgcccactctcaccactcttagtcaatatagtactggaagtcctagccagagcaatcaagcaagagaaaaaaaaaaaaaagaaacaaaatacatccaaatgggaagagaggaagtcaaactatctctcttcacagaggacgtgatttatgtctggaaaacctcattgtatctgtctaaaaactcctggatctgaaaaacaatttcacaacgttttaggatacaaaatcaatgtacaaaaatcagtagcatttctaaacatcaacaatgtccaagctgagagccatatcaagaatgcaattccattcaaaatagcaacaaaaaaaatacaatacttaagggtacagataactggggagtgaaaatctctatgacaagtattacaaaacaaagatcaaagaaatcagagatgacacaaagaaatggaaaaacattccatgcccatggataggaagaatcaatattgttaaaatggccatacttcccaaagcaacttatagattcaatgctatttctatcatattactaattacattttcacagaattagaaaaaactatttggaaattcatatggaaccacagaagagcctaaatagccaaagcaattctaggaaaccaaaaagctgaagtatcacactacctagcttcaaactatgccataaggccacagtaaccaagacagcatagaactagtacaaaaacagacacataaaccaatggactagattagagaacccagaagtaatgtcacacatctatagtcatctaatcttcaacaaagtagacaaaacaagcaatgtggaaaggattccctattcaataaatagtgcttggataactagctagccatatgcagaagattgaaactagactctttcattttaccatatacaaaaatcaactcaagatggattaaagacttaaatgtaaatcatacaactataaaaacctagaagaaaacctagaacataccattctggacataggccctggcaaagatttcatgacagactccaaaagcaatggcaacaaaaacagaaattgacaaatgggacctaattaaactaaagagcttctgcacagcaaaagaaactatcaatagagtatacagacaatgtacagaataggagaaaatatttgcaaattatgcatccaacaaaggtctaatatgcagaatctataaaaaaaaacttaagcaaattaacaagcaaaaaacaacttctttaaaaaaaatgggccaaaaaaacatgaaaagacacttctcaaaagaagacatgtgtgaccaacaagcatatgaaaaaacgctcaacatcactaatcactagagaaaagcaaaccaaaaccaccatgagatatcatgacacaccagtcagaacggcaattttaaaagtcaaaaaataacacatgttggtgaggctgcagagaaaaaggaacagttatatgctgcgtgtgtgaatgtaaattagttcagacactgtggaaagcagtttggagatttcccaaagaacttaaaatagaactaccattcaacccaataatcccatcactgggtatataaaggaatataaattgttctactgtaaagacacctgcattattcacagcattattcacaatagcaaagacatagaaccaatctagaagtccatcagtggtggactggataaagaaaaaaatgtggtacacaaacattacagaatactacacagccataaaatagaatgaaatcatgtcctttgcagtaacatgaatggagctggaggccattatcctaagggagttaacacaggagcggaaaaccaaataccacatgttttcacttataagtgggagctaaacactgagcacacatggacacaaagaatggaatgatagacaccaggggctgcttgagggtggagggtagacgaagggtgaagattgaaaaactaccaattgggcactatgcttattacatggtttatgaaataatctgcacaccaaactctcatggcatgcaatttacccacgtaacaaacgtacacgtgtacccccgaacctaaaataaaagttagaaaggaaaaaaaaaaaactaaatccctatctcacattatacatctaaaaaatccaaatagattagatttaattaaaaattaaaccataaaacacagaaagaaaatacagatgaatagttatataatttaggatgagaacagcctctgtcaggatgaactaaagaattcacaaaaaaaaatgttaacaaattaaatgacatgttaaaaatctggccaggggtagtggttcacacctgtaatcccagcactttgggatgctgaggcgggcggattacctgaggtcaggagtttgagaccagcctggccaacatagtgaaacctcgtctctactgaaagtacaaaaattatccaggcatggtggcacacgcctgtaatcccagctactcaggaggctgaggcaggagaattgcttgagcccgggagacggaggctgcagtgagctgagatcatgccactgcactccagcctggctgacagagggagactctgtctcaaaaaaaaaaaattaagaaactatatattgaaagactataaaaaatagttttggtttttttctcagtaaaaaaataatatatccattgtcaaaaattttctattttcaatattattatttaatagaaaaatttcaacaatttctggagaaaatatatgaaacacatttgacagagttttaacatccttaacataaaggatgtaacttatatgttacatccttaacataattttctttgttcagttaacaagtttttattgagtatctatattgaaatatgcactatgtctgacactggcaacacatttgaggaaataaagaagaaaaattcaagtccacatggaaaaatggactaaggacatgaaaaagtataaatcatcagtacacttctaataaagttaataatcaaagaaatgcaaataaatgtgacctatcaaggtcttgctatttgtactgtcaaattataaaaatacaataacaaatattggcagatattggggaaacaagtaatgtcatatactggtatgtgcttaaactggtaaaagtcttcagaaaggaaattggaaatatatgtaaaaattttggacagttgcatattctttgttctagaaattctacttatatgattagaacctaaggaagttatcatagatttaatcaaagatagttacaggatattcaacatagccctgtatataacagccaagaatctgaagccaacaaaaaatatttagcttaaaatgtatagaatatacataggatgaaattgcataggtcactaaacagtttctagggacatggaaaaaaaaatgccatattgcagaaatgcaatattttgggatgataaaagggcagtttcaaaaaattgaaaaaatagcagttactatgacctcttttggcaaaaataattatatgtaatattgttcatggaaaaatagactggaaatataacgattaaaatgttaattgtatctgggttggtgagattacatataattattatatataatctttacttttttagattgttgttcacagtgacatcaagatttgtcatgggagaaaaaatgaagaagattattattttgtagtcacccaaggagagaagaagtcacatctctggagataggaggagatagggcatatgagccaatcacatttctgcagccttttgtggatacaaaaggggtgggccaagcctttccaatatcccttttcctccttggtacccagacagactatatttaccagcctcctttgcagccaggtgtggtcatgtgactcattcctggtcaatgaaaggtagatggaagcctggcctaggaaacaggtctacatgcaatcttccattcttctcccacccactggctgaaaagaaaggcttctgaggacacagagtggggggaaggctaggtagaggctggatgggaagaaagcagggttctcttgctcctctcatcagagagctactgaggagacccaccgcacccagacccccatactggactgttacaggagtgagaaataaactttgtttagaccactgaaatttgagagttagagctattagcctaccctgattaacgctggggtagcccctcacatctgcccagcaccctcagcagagcctaacccaatcatccaaggttacccaatagagaactcaggcttccactagagtagccgtcacatagagttactgggtcttccaggttctgccacctccaccgtgttttgtgggactctccactgaactcacaaagcacatgtattcagctactccaaagctatgtgtactcaggaagagaaagttctaaatgtttctgtgaccttgtgccactgatatcatgggttctatccttcagagtgctaagaaaagtgttaaatctccagaatagctttggaaaagtggagaaatttgagactttctctatttttagttgctaatatgcattcctgaaaagtttatttaaagccacaaggaaatatttccatattgaatttcaatattgcaatatactattttagaataaaatggaaagatccaggacatagagcagctgagaagctacacagttggcccctgggcttcactcagacagtgcttctctaggctgcaagtcataagtctttgtgtcacccacttttagaagacatcccccggacttctgggaccaacctgaggtttgtaggaatctctgaggatcaatgatcaaacatatattagcttgaaaaaaaactaatatatgtgtatgtttttttaaaaggttaagtttttaacaatttagacgtcttggcattatactctgagaacgttaaccaatgagaataagagtgacaatttagatgtaaaacctcttaaaggtaaagataaaatcctaaccacatggggaaaaccatgtgttctgtggatgatttccctggatttctcaaaagactcttagaatgttctgggtatgactttgggggcatctgttctatgaagatgggcaccccagcatcacctgcatattaacccttcttcttgctcctaaagatgcagaattagctgagattaggaagatgtacaaagtgttctccctgcacttcaactaatgaacaaaactttttaaaaattacttatgatttggaactattttatcattttatatatcctatggcaactggcattttatatttaattttatcatcttttgctttttttctttgatctaaatcaggatgctaagttttgggggggggtcctacagttttggcagagacctcattctaaaaaagaggtaccagactattaaggcagaatctgctgagggtggccccaaacctggtctggtgaacctcactcaactcatcattgatttcaagggcacagaagaggcaaggagatgacagcaggagaaatggacatgtaccatggagaaaggggaccaaccacaccttctgtccaaactgagatttcccagcctgaaacaggtcaacactggggttagcaagaaactttaaactgaataggagattaaagtaataagaagatgagtactattattggtacaaattatattggtaatagttttaagtttcattctttaagacagggtgaatcacagtcccttctctcaaggtccttgtcagcattctacttttccaaggacattcaaaaatttctcatccaaagtcaaacattagtgtgtgtgcctcaaacaagaaatagttttccatcagtctccaaatctttgaatagtaaatggcaaaagtatggaaatgcaagatggagtggggcttaatgttgccacaacattcctacaatactgggatagtcttccttgggaattactttctttcctatcacgtatcaataaggaaagccaaatgtagaaataaagaaatctccccgatttacttaacacacggaggtgacagttacagcgcaaattgagggaagagtaaatgatttccacaaatgaaccaaaaacacttaaaagccacatttaagagaaatggagtcataaaggcaatatttgtgagcagataaaaaatcagcacagaaaaaggtgagaaatacacaatgtctttcatcaaggtgcaaggaaatgtaaaataacattaaaagtaccaactacataatttgaatataaagagaacaatagcaagaaaggagaggggaagtgatggcgatatggagacacagtctcttttgcatgcacagggcagaaccggtgcctcaggctggagggtgtctgtgagtaccccacaatgaaagcaaaagagcacccagcattgaagccacagaccttgctccatgaatcctagctgatgggctggcacagagagatcaggagcagaacaaggaaatccataggaggatcctcccaaagtacttttttttctggtccaaaaatccttaaatctgtcagaagcaggaggttggagtgggagaattgcagagcctggaacacacctgcctgctgatgacccattctgagggggttctttccacttggcagcaatggacttggtaaaaaaaataatagatccttctccatggatcccatttccctttttttttttttttttttttttgagatggagccccaggcagaattaaagaccaactctgggacccaaatttttagaggacaaaggttgatataatggccagcacgatttagtcatttagatttcaggtctaactaactgatgacagactttaacaaaatcactgaaagaaatttaacgtcaaccttaaataacagtagaggcaggtaatataacaaatagagtcaaaatggtttatctaaaggtctaagcccaagaaacatccaacaataaaattaatctaaaacaaattttttaataatcatttttttttcttgagacagagtttcgctcttgttgcccaggctggagtgccatggcacggtcttggctcactgcaccccctgcctcccgggttcaagtgatttcctgcctcagtctcccaagtagctgggattacaggcatgcgccaccacgcccagctaatttttttgtatttttagtagagatggggtttcaccatgttggtcaggctggcctcgaactcctgacctcaggtgatccacccaccttggtctcccaaagtgctgggattataggcgtgagacaccacacccggcctcatcttttctttaacattacaatttcccatcatggtggcacttgacagtagtgggactgtccaacagcaaatgaccccatctaagcactcaggacagaagccattttaggtcatgaaaattatacagattttgtgagtgaagggcatttagttctgagcagaaagtagtcttgcaaaagggaaatttgcaacaacaacaaaaaaggacaaggagggtgacaatgtcaagcaaatgataaccctgctggagcttcagaaggaaccagctacatccctttcctgcttctacagatgctatggcagccccagaggtgtcccactaggatctcccttcaagaaagaatctagcatgcatctgaacaacctccagctgttcacacctcaggccctgcctcatcccagacagccctgagccaatcactgacacagcagggtactagagcctggtcatttctgcccaacccggggcccctccaaaggcaagctctgctccagacctccccgttgggttggtcaaactatcaaatctgtacctggtctgaggctctccctgcccagtcttgcttcatcctcattttatccttcacaggcacagcccccttccccctccaataaaacactaacattcctaattccgtctcaacatctgcttcccagggaacctaactaacacaatactcctaaaaccaataccagcaaaaagtgactttccaagcccctacatgaagactcattttctggaaaataaaatttaatataattccaattacccatgacgctatttagccatttcaaaggaaatgagaaagcttcccaaattgtggtcctcatggagtgaactgatcatcaaatgttgctgtttacatgagggcacacaataattagggttgtatgtaacatgctactttcagattttcaggtaagtctaaatgcttttaattgatgcaagaataataagtccttcagttgatttatgtcatgcattaatatcaatcaaaaggttttctaacacatactttttaatactataaaatgtggggttttttttaatgtcttttttttcttattcagagccacatttcttcacatggtatgttttacctaacctaagggttatgttgttcgtttgtttttaatttcaggtttgaggaatcaagtaacaggtctttctaaatccttttattggatatatgttagttttccattatcataaaagactgaggaacaggaacagcagcatattgtttaaatgattcacaggtaaaaatatcttctccctcttggtctgttttctttcctgatgtctttgctcattgccaacattgtctattttatatataattcttgcaggacattgtgccctgaaggtgaaattggacaggtaaggagatgacccaacaccccttgtcacacctgcaggctctaggtcacttttgtaacacacaatgaaatgggtaaattctacacaatcctttttttttttttttcaaacaataacagaaagtaaatatttgaactgggggctttttcaaacaacacaagtcagaaaaaattgacttgtttttgactgttactttaggcatatatttttgattaatgacaattaaatgtaaatataaagatattttaaacttgaggttttaaaacaaagaatgcaagaatcacctggttaaagttagatattttgtcagtctcaaagtcagttggctggataataccatatcataaaattttataagactaatttgaaggtccatatgaattggtattattgttcgtttttcaatattgatcttagcagtgtatttacagcatacagcagagttaatgtttaatacaaacaaacaagactttccagaaaatctacaaagaatcactaactaatagccatgcttcagttaaatttgtttactttttaaagtacattctcagaagtaacatgtactctcaattaagtaaaacacaaccagaattttggaatttgatctttaaaataataaaaaaactttctctgctatttacagccttggttaaaatcccaacatctggataccagaatctgagcagcaaaatccacggagacacatgtgcaattttatgcctgcaagctcactattatttagaacgaaaccaacgtagtgcatctacccttgtttcttgctacacagaatgtatccagagtacaaactaatgtagattattataaaactcagtgtgtagatattatatatatatacacatgcatacatacacgcacatatataactaaaacaaaatcttcaaaaataatactttttctttctgtatgtgatgtgccctgatagtttccactttactccatcccatttccttttgttaatactggccttgactcacttagacaaatgggtcatgacctgtagtttggaaaacagggctttccagcctggctttaaagaggctggtcctcaggccagcagaaccagcagcacctgggggtagtttgtggcgcacaatctcaaggcctgccctagacctactgaactaggatctgctcttagcaaggtccccaggtgacttatggatgtattaaagtttgagaagccgtcctcctgcatgcaaaagtacagaatgagtatctgtgatctgaactacatttaaatcgataatgcacctcttaaactgtctttgttcaaagaacttctatcctactgagctcaaggagcaacacagtttctagcaagataggtgcaaagaaaaattcactttcaatttcatcaactgcttcaagaggttgcagggactggctgacctggtatcccagctcctgcaggaccgagagtgtgggaggtgggttgaggggaggtactgaattgactgcaatagatccatgagcatataaaagtgtgcgtgtttgttcttattcctgggagaaaatatatagtattcacctaattttaaaagagttttatggtttaaaaagttaagaagagctactaagccatgaaaagacgaggaggaagcttaaatgcacattactataccagataagaaaatctgaaaaggctacatagtgtatgattccaaccatatgacagtctggaaatggcaaaactatggagatgtaaaaagatcagtggttgtcagggcctaggaggtcgggagggatgaacagacacagctcagtgaatttgaggggcagtgaaactaatctgtatgatattataatggtggatccgtgtcatcacctgtttgtccaaacccacagaacatataacaccaagggtatacggtgtttatattaaagtataaccctaatgagaactctggactttgggtgataatgatgtgttgatgtaggttcagcccttgttacacgtcagccacccatgtgggaaaatgttgatagtggtggaagctatgtatgtataggggcaggaattatatgagaacacttgtggtatatgctcaagtctgttgtgaacctaaaactgctctaaaaaataaagtctgtaggtatctatgaaagcgcagacacatggtccgtgagagcacgtcctctctgctataaattggttgtatggttacaatcatacctagaaaggagagaaaataaagagtaagtgaataccgacatgttcaattctgccccagaatacaacaaagtccctgaatcactcttgtttcattgttgccattgcttattcaattcagtcaactcgtatatgtgaagcatgtgctacatacataacgtataatgcaggatgcaaaaatgattatgtgatcacttcaagtaatttataatctagcaaacatataaaacaggcacacagataatccttacatagtaaatgcctcctttttccccaaaatggcaaggagacaaatagcaaggatccgaggacagagaggcaaaattcagaaggccagaaaggcatggagccagaaatccaattcactcgcgagtaaggtatcgggagagagtggtgtacaacgtgacagggacacctgttgctcccaattgtaatcttttctgattggtttatgcccctttccaattactgtgtccatgctaattatcaactatttttattatcaaccctgcagaggggactaagagaaaaaaaaaaactgctgcaaagtgatgctgtgttcattttgcacagaacccagaaatcctgatgaaggaaactgaattggatgccacaagccttatctcctgtgaatgctgaatgactttgtcggtgggttttacgataagatgtactttcttttatatctattaaacaagctatacagaatactggtaaatacacagaagtaaaaagaagaataaaatagataaaattttctaagttaaaagctaagggaaaaataaaaagaattatcaattgatgtgatcaaagaaaaatgtttatctcatggggtgttggaaaaggaacatcataaaaattaataggtagaataatcatcaaaaacaatctgcacaacaaatattacatagctgaggggaactatcattaaaatataatgtatacaaattgctgagaaactcactacaccttctaaatcatgtcaaaagagttgtttgcatataagctgtctgcacttcttctctctctctctttttttttgttcatattcactgcaaggtggcttttgtccacccatgcaaatcactcatatgaaggtcacaatgatgtccaggtggccaaagcctgtggctaatcctcagtcctcatctcaccgagacagcagtttcttagcccttctcctacctccactggcttctcttctcagctcctctgtagttccccctcctctttccaacctgtatgcattggaggggcccaaagctcaaccctaatgctcttctgcatcttggtccctaggtgatctcacctagtcacccagcctcagatagccttaggcttaggaatcacaaatatatctctcacatgacctctagactcatatcaacctctcaacatcacaatttggatatccaacaggcatctccaactcaacacagccaaaccccacttttgacttcctgctcattgcaactgtcccctcttgcagatgtcccttttagagtaggtggcaccatcatatacccagttacaaacaaaatctttaaagtcatccttgactctcctacactgcatatctaatccatcagcaaatgctgtcttttccaccttcaaagtagatccccagtctgatcatttctcactacctcccctttcgctgcctggtgcctggcaatggcctcctaattggtcttccctgtttcaactcttggtccccctctagactgttccccacacaacagccaacatggttcttttagaacttcaaccaatgtaaattatacttcaagaaagctttaaaaaattcaatcagatcacatctgctatgaaccttccaatggttctcctcccgcagtgtgccaaataaaatggaaatgcccttatccttgcttaacagaagtctacaacacagcctcaccagcatgcctccaactcacatcctgcagctttaacctcactccacgccagcccccagtctccttgccgttacttgaaagtgccaggagagctcctgccaaagggcctttgcacatgctgttccctctctctgcaatactcttccccgtgtgatcatacggctcatgctcccactcccttcgggtctcagcttgaatgtcacctcctccctatgaccttccctaacctttcgtgtaaaattctacctctcccttcctcagtctcttgcttctcctgctttgttctggagaataccaaccagcaccacctgatttgtaactattcccttgagcacattctatctcagccacgggaatggaagcttcatgcaggcggggacatcatctgttcagttcatgctgtagcccagcaattctgaatgattagattgaaattggatccaaaaatatcacaaatgagataacgtaacttgttgataagtgtgtgaagagtatgaagagatgatcaagctcacaagtttccaagtgctaacatctataaaactccattgtcacccatcaaatcagcaaagattaaaaaccacaatagaatgtgataaaatagtgctctcagatacttcctggagaagtatagatgggcagaattgggtgatctggtatcaatgatcattctttcataccaatacaccatgggattttgcgatcagaaggtaaagaagacacagaaggaaaagaaggtgaagattaaaccagcaaaaacccataataagtaggacttcttcctattcattagtaagaaagagttgggtgtccccatgggaaaatgctaatttagtgtcctgaaccactgtaccctccaattcctgcttcccccacaacagtggccccacactgagtcctacaacgaggataatgatcctcaacccccaattgcacagacagggctaagtcagagacagtgatgccaaccttgctgatgtctctaaaacactcaactactgggggctaaccctaagcaaaattattgactccgattcctaagttaatttcctataaggtggaagaagcaacaagtgtcacttctcttctgggctctatgacaccaaatagtggagccgaagagacttgctgatgttttgaaacccaaggccaaataatgctctctaaacccttagaggtgtgactaggatattcacagaagccacgcaaaagacagcagccttcaatgaagaaacaaagaaacaaaaaacatggttccttttataaatatttatcgattatctaaggctaggttaattgttgataactatcaattatctgagcaagatacgcagaaacacttcaggtgcttgaactgcagcatcctgggctccaacccaaacttactggagaagaagctttagataccaggaatctgcattttaaccaactcctcagggaaactgccccagagggggtctaggctaaccatgcgcaacttccacccattctcctgggaagtgattgtgaatctcctccaaacccctcttacacttcctgattaagttggtgccccctactgaatgtcagcctcactgaatcttaacgaggaatcgccagactgggggggggattgtgcagcatgtctggggaacacttcactacttcactaaaccctgctgcacacatgctgaacaccgttccaaaggctacaggaactgagcaccgcattggaatctggccctggagggtgcccagcatggcgaccctgaggggtgcaggaacccagtgagaaggagaaacagaaggtacagtccagctcgagaccacgcacataaagaaatctgtaggcagggtctctattattgtgccatattaaatatcttgatattttaaagcaatattatttttctgattataaaagtactcattgtagaaattttaattgtgccatcatcctgcagaaaaatgaaagtacaaaaaacgaaaaagcagctatacacggccacaaagtcacagggctcatcgggatgtgctaaccaggctggaaactgatcaaagctgatttattgagaaaaaataggcagcatatcaaagacttacatcagcttcatagtagacagactttgggggcgggggaactctgtctcttttgagtatattctcaaaaggataaactttcaccttcctgtgaagcacagttactataaatcagatttgcaaactgtgagaaatgcttacaactcaatgagtcttttgtcagccagtgggggctccatcgtgaaatccacccttcgccatagcgatgggataaatcatcaccagccccgagacatcgcctaatcccttcctcgcaaggcagattcgggcgctttctgcatctgcttcgtgttattgaaaagagctcggctcatctgctgggctctcaggcttcacagtgacctcgcacagaacgctgctacttctgaaactgttttagactcttccgtctatgaaacagacacagagtttaagtttagcgtcttttatggtcagaaatatttagcgttacttccagagcggcagccgtggaacaatgtgggaaagaagtgcttcagttcacttcttgggaagtactgaccctgggtcaatttaattttttccgtaagatttccccttcttacttttctccttccactgctatatgtaacagtatctccccttccactgctatatgtaacagtatctccccttccactgctatatgcaccagtatgctagtatacaacattatagattaataatatgctatattgtttaaaaatattaatgttatataattaacatggtgtgcatattattatattgacaatacgtaatgtgatgtgataataagtctcactgagtgccaggcaccgctttgaatgctctaaactcattagctaatttattcctcgtgattctatggggtagatgcactatttcattcccattttacagctgaggaaactgaggcagctagtaacaggtggagccaagcttcacactgagatcatctggccccagcacactcataaaaatgagcaaaagtataaaagccaaagggaaaaggaagccaaggggtgaaaatcctaattacaaacaaatcctgggtaagctgggtttttagtccttccccacatgtgaacagcaactagaaacctgaacagtgactttgtttcccctgtcatccattgttggtgcctgatcctcacacaaaatcttacggagcagtatctagtgattagcttagctgaattgagcctggacacccttcatgagctggaggacagaggacgtgtcgatggagggtccaacttcaggcatctgtactcgcctgctacaggtgagtggacctatgaacccccagcctcatcaagcacccgagggtcacctgcctgcttcacctggaagagacagcaaggtgtgatcccaggaagatcctctgccaggaggcttacaggcagaagcagcggctgctgaacatagatgctgtcggcaggacacaggggtgatagggggtgagccagtggagcaggtgaaggtgcagactacaggcagcccccctgagatcctgcccagaccccagcagcagctcccctgtccctctctagcagcttcgctgtgcccgaagtgtttgagaacaggtgacccatgccctgagtggcagatgctgtgtctttttgatcccttctctccctccccccccacccccagtggggtacatggaaggtttgctaaatgtttgttgaatgaataaacgagcccaagtcagaagcagtctccaaatcattcctcatcgcaaaagggtgcggtggaaaaactcacaaagccaaggcaggaggacacactcaacttggaaacggcccgtgcccagctttggaacaggcacagcctgagcttcaaggaagtcacttgaccagcagtagctcccacctttccttgcagctagaacagcatcagaccaagtgatctctaatgtgatgatttgctaaagtacaatgagttttacaactagaaagtaccttcctctcaagactgacttcactatgagccacctaatttttcctctctcttcttttggtatttttgttgcaaatagtacacacaaaacaggatatataatctatttgtgcaatttaaagaataagaagcaaacacctttgcaggtactccctagtccacaacagtcagccccaggacctcagaagccccttatgcctttcccctaaaactctcccctccctgacaaggtaattccaatgctgagttatgtggttttttttccttatttttcttttcaacacatattacgtttctctgaataatatgctttttaatgttgcctctttttaatctttatttgtggaatcatattgtatgtaatctgtgacttttttctactcacatatgagaaccatccacactgatacatggctacagatagacacttggagtttatttttcactgctgtatagtactccattggtggagtacaataggtttatgtatccacttttctgtagatggacacttgggttgttctgtttttgctcatacatacctcctggtgctcaggtacaagggaatacagacccagggtgagactgctggatcacaggctaggcacatcttcagctttactaggtaacaccaagccaatacaaaagtgcttgtacaaactcatgctcctgccagcatggaggacccactgtgccacataaaaacatcactgttattaacttgttttatttgcatatgattattttttcccttatccccaaccacttctcaaagcaactagccagcatgtgccacacaggcaagcacccactccaatgtgatctatatggttaggtatgtatgtaccctggaaaaccctgtgatgttgcttgaggagtatataacttttttatgtatgtaagtagcatgtgctacaaagcgcgttctgttttctgtatttttcactccactcagtgttttgtaaaacatgctcatgttgctccataggtatcagagacaggatgatgttttatctttaagatgggtacgccaccctcattttatagatcacagtgatagctcacaattgtttagtactcagtggggtctaaatgtactaactcgtttaatctcccacgaaccctgcaaaacagatgcttccgtttcatataaaatgagaccaaggcacaaagaaactaaggaacttgtacaaaatcaccaagttagtaaacatcagagcaggatttgaattgagccagaatgtgttcttatccacgacatgaaactggataagaatgcaaagctcagagaattttcatgactagcatctctgggattcacagctggcgaccacggagcagaactaatatacagatggttcccctctcagtccagtcctcattccatcggctccaaaatgtgtattattctatatgattagctggtgaacaacaaaggcaattagttagtcctcttcagcaaatgttagtaaatgaaaatattatagagacagaactctttttaggaaatgcaatcatgtgaatttaaaaatgctttatcagaaatagaattaatgacaaaaatatttataggatcctaagaaaatggatttgctattttttttgtcggctgatgataatcatctgggtgcatctttggttgtgacagctccaccccttcagagagttgtatcttcatacacacctaacatgctaagagtagatgtgcatgatatggtagttagtataatttctgtaataaaaaaagtacttggtcatgcctgtaatcccagcattttgggaggctgaggtgggaggattgcttgagcccagagtttgagaccagcctgggcaagatagtgagaccttgtctctacaaaaaaaataaaaattagctgggtgtagcggtgcacacctgtagtcccagctactcaggaggttgaggcaggaagatcgcttgagcctgggaggcagaggctgcagtgagccataatcataccactgcactccagcctgggcaacagagcaagactatgtcttaaaaaaaataaataaaaataaataataaataaaaaatttttaaaaaaggtacctggaacggcctgcaaagaaagggaaatcaaattatgcttcaagacagtcactattatcactgacagagaagcagctaaaataaacagcctgctcattttgtttgtaaatgaattgccacaattcttgcactatttaaatcaagaatattttatattccatagttttcaaccacccctcctttttttattgtttccagctccttaaacatataaaaggataaaagccatttgttctggcagaaaagagtcatcataaattttgcagagtgaatttctctaagatgaaaggaatgttcctctcctccaggacagcctacggacaggactgtgatgacacagagtcttcacgggaatcacacctgcagtgttaagccacttctgtggaaaactcaagtccttctcagataacaaaaacattttagtagcaatgaaccaaaaacaaaatcttccactatatatgttaatacatcaaaaggaaccattcatgtgccatttataagaacttccttccggccaggtgcggtggctcacgcctgtaatcccagcactttgggaggccaaggcaggtggatcacgaggtcaggagattgagaccatcctggctaacacggtgaaaccccgtctctactaaaaaaaaaaaaaaaaatgcaaaaaattagccaggcgtggtggcaggtgcctgtagtcccagctactcaggaggctgaggcaggagaatggcgggaacccaggaggcagaggttgcagcaagccaagatcgcgccactgcactccagcctgggcaacaaagcgagactccatcaaaaaaaaaaaaaaaaaaaaagaacttccttcccagaaatcatagcagcgttcctcagcccaaagccagaagaaacttctcgcacatgaaattttacttcaaaaactcccatatcaggcattttaatgaatcagtggaagaaaattatcctcccaactttgttgtcaagaaccccaatttcatatgcagaaaaaagaattacaaaaataattattcgaattctaattggtgggattttgataggtttataaaggaaataaatatctttaacacaattctacctcgcagccaacatcagctattagcaaccacacttcttattgccagttcatctctccaaacacacagaagccatgtgagttgaaatttattttttaaaaactctcagttatgatttctcaaaattatatttcatatattgacatcaaccaatatgatgatgatattatatattgacattaaccaatacgatcaaccaatatgatgataattgtagggaaaagaaagagagatctgactgttactgtgtctatgtagaaaggaaagacataagagactccattttgaaaaagacctgtactttaaacaattgctttgctgagatgttgttaatttgtagctttgccccaaccactttgccctagccactttgacccaacctggagctcacaaaaacatgtgttgtataaaatcaatgtgtaagggatctagggctgtgcaggacgtgccttgttaacatgtttacaagcagtatacttggtaaaagtcatcgccattctctagcctcaataaaccaggggcacaatgcactgcggaaagccgcagggacctctgcccttgaaagcggggtattgtccaaggtttctcccatgtgatagtctgaaatatggcctcgtgggatgagaaagacctgactgtcccccagcccgacacccgtaaagggtctgtgctgaggtggattagtaaaagaggaaagcctcttgcagttgagatagaggaaggccactgtctcctgtctgcccctgggaactgaatgtctcagtataaaacccaattgtacatttgttcaattctgagatgagagaaaaaccgccctatggtggaaggtgagacatgtttacagcaatgctgctttgttattctttactccgctgagatgtttgggtggagagaaacatacatctggcctatgtgcacatccaggcatagtaccttcccttgaacttaattatgacatagattcttttgctcacatgttttttgctgaccttctccttattatcaccctgctctcctactacattcctttttgctaaaataatgaaaataataatcaattaaaactgagggaactcagaggccggtgccggtgcaggtccttggtatgctgagcgccggtcccctgagcccactgttgtttctctatactttgtctctgtgtcttatttcttttctcagtctctcgtcccacctgactagaaatacccacagttgtggaggggaaggtcaccccttcagataataagataaatcagagccgaaaacatagttcattcctgaaatcaaatatagaacgtttctaccaacacacattttcaaagatggtgttttcaggtttgtatgggattgtttcacctttatgaattagctttttaaaacctgtaatactttcttgctgacttcatcatttccttctggttgcctggaggggtggtgtggaatgctaataaaatgaatttcagttgccgtccctcacaatctgaactatagaagatatttattgtctcaacttccctatgagcttttctttgcatcatgcagcttcatggtcagcagacactaaaaattaaagaaagtctttctcccactttacttgtgtagcacagacacactgatcaaatatgttcccagcacttccgaagaaaccttatcacatccacaagagatttcctacttgcactttttttgataaacacaaccatcatagcccaacaaaacatcacacagaaatcaaattatagtgtccccataagcatctgctcctctatggccttgggcaaaatttagaatcctcgacatccctagagttaccacaatctctgaaagtgaaggagcacccacaaagctcaaggaatgcattgaaactcttattacttccaattccattttcaaaaaaagtaaatgtgtgtgtatgtgagctgcacatggtccagaatgcctcaccaaatgtattgttttaaaatgtgtgtacgtccatgtgtaattgtatgtgtgggattttgaaaggctttttatattttattcaaaaaggtacacttttcaatatcacaaactttgctttcaattataagcccttcccattttcaattaatgttttaggcaaggaatatacattagtaaaaccaaccacaccacttagggaaaatgaattagtatggggaaagtgaagaactggccatgcagtcaattactttggccagcatagatatagttgaactaaccagcacaggtgtagacagcctgtttggataaggtagcttaagccccaattttttctgcagtctttatttttgtcaaatatatgaaaactaccatctcatttcctccctgtagctattacccacatgtatgtgtagtgtcaaaataaatggccagagtcctctcagggacctcccttggcacaagtcgcacttcctcaccctctcacctccagagcctcaggaagtgcaggtcagaaagcagccagggcaggtgtgaggtgatggagcgctgagtgtcggcgagcccagataaaacaacgttccaacatcggaaatccaatcattcacctacttgtctcctgctcgctaaccccaggcaagtataaaggagatggaattataacaggagttagaagaatttggatgtgatttcatatattaactcagcaaaattttttctgaaaaggtccagacagtaaatattttcagctggcaggccatatggtctttgtcgaacctactcaactgtgccattatggagtgaaggcagccacagatgatatagaaatgaatgcatggggctgtgttccaataaagctttctttatggacactgaaatgtaaatttcatgcaatttacatgtgttacgaaatatgcttcttttgatttttcaaccatttaaaaaagtaaaaaccattttcttagctcctgggctgtgttgactgacccctaattaactgatatgtgggctgctatccatgaaaacctaggcacagaggaaggcagagctggcttcccagccaagacgggacttaccttgatatgagctgctgggtccgggacagtctgaatcatgtccttcagtaagccagcccatctaccagctgttcagaacctgacggctagaagacaaaaggaacaacatacataataataaacaactgcatttctgtgttttatgttctagcaggacaggacacaattcaccaatggcaaaagaatcatagctttacattaaacatgtttgcctaaaggcatcctctaggtacgtgtggtccatgaggtgactagataactcacttcccttccattgggaaaatcacttacaatgagcccaagagaaccctagtccgacaggacagaagaatctagctcaagctaacccacatcacatgcagcatccacacatccttccacgtgggcagcatctaatgagggatccattaaaggaagacgtgggactaaaacagggcatacttctctatcatactgagaaaacaggactttgaaatcccaccaaaactcatgcgatctgcacatccttttcagctttgttattaagttcttagtaaacagcacagctaccattcattgagtacttcagcgccagttccttgagcgctaagggctccacacacattttctcatttcattccaaccacgactctgagagctgtcattcccattgtccagctgtggacgtcaagactcataaaggttactgatttgtccaggatcacctggttaataagcgacagaaccaaacttcaaatcagattaggctatctgactccagagcccaaaaaaaatttggtttgacttaattagcaggtatcaacccacattttgaagggacattttaaaacaccgcttaaataaattaaatttaaagatgcctataatccaggaattttccagaaataaatacttcatccaatatattcctttattcaaattataaagcagcatgttctgaccactgtctgtgccctccccttccaccgagccagtctccaacctccctttgctgtcacaggccccagggctgacctctacagatgggctcagcagggtgccttgcctcctggccacctgtcagggttggttgacgtggccccctctggagagcaggggtgagaggagaggggtatctcttcccctcaccttcccaccaccgacacctgccgcccaacctccctgggcgcttggttatggttctgactgcagctggattctagggggacctctcccgtcatggggcccctccttccaggctccagcctccagtacctggtccccagccagtctctggtgctctgcagatctcagccaagccatcagttcttttttggcactaaaaatgccttttttagtttacatttttagaagccatcacttgctttttatcacctgtagttttttgtttgttttctcctttacaatggctctttgcagtaacaaatgcaaaataaaaataaacaatatgattacagaacttgagacattttcgaaggctgtctttcaaatttgctactgagcgcattactgtagtgacaagtgaaagcattcacaggagtcctccccacattcacatctgtcctttctgacctctcacggtacaggcacacccattccaacccaattgcctctcatgaagagcatctacctccagatctgcatgctccacatctgtcttcagtctccctggaggcctcccaagattggcggagcttggctcaccaagaagatgacatgctgggaaccttaggcattttttttctataaccaaatttctaggtcttggaaaatatgtacttccccccacccccacccccaggcctaaagtccctctgggggatgagagttactgaaagtacagagggagtgaagtgcagtcctgaaattgaaccgggaagcagatgaaggtgaccaggctcctggtgctctcgtgggagaagaggctgggagaggatggggcctggctgaaggtttctgggagcataggaatcctcaactccccttatcctaagagcagcaggtgccacaggaaaacaccactctgctcctggggtcattcagcccggaaggggagcgtctgcaagccatcctcacaaagggagggcgtcccactgcacaaccctgctctggggagcacatggctatttccgtatgtctggacattctctctggactagttcactccgcacagttcctccctgcctgcacacacatgctgacgctcacaccagggactgaagctcgtccccctcccctcaaacccaggctgacctgtggctgcctctgacctgcagaacacagcagagggaaggtttcaggagtcccaggctcaggcctttatggaagtgggagcttccccttcctgcctcctgaaaccaagtccccataccctcagcagcacagcacatggcagaggaccgagtgcccagtggggcagccagcaccaacgccaggcccgggagggagttgtcctggacagtccagagaactgactctcagatgaccacggcccctgccgacatcagggaggcagcttccagctgagtccagtcagcccacagaatcatgaccaataataaatgggttgttgtactaagctgctaggatttggggtagtttattacacacacaggtcattgaaacaccctgtaagtgctctagaggcacggagaagatagagggtaaatagcttgtttcactgtcactatggataagtacaaagatggttccaacactcaactcctcctgtacccatgctttttgccacataactttgtgattcttcccattaaagaggtagaattacttcccaacccttatttttgggcggcctatatgatctgcttcagccaacaggcagtagcagaaagacaagtatgacagatcctagctgaagcctcaggaggcaggacatgttcccctttgcttttctgtaactttccaccagcatgggaacatggccagatgcatgcgggaggatgagaggtacctgaggcagagtcacccaccccaatcaccccaccaagactacgtttgatcatcccatagacaaccaaaaccccagacatgggagggaggcaaccagaccagccgctagccaagtccaaccagaatggccaacccacaggctcatggctgaataagtgcttactgcttgaagccactgaaatttggggaatttgttacacagcatttttgtgacaatagattactgacatacactttgcaatgtacaatcagattaccgagatcttcgttaaaatttttctagccagtgataaaaggagactcaaacagggcatttcaaaggaagccacttcatcccaacacagagacataatatttccactcacctacgagacatgatctcaaaccctaatcctgccctcaaaatgggtttggaaactgaaggataaccaagaaacctccaccagaagcctccatgggattcccagagcccttcccaggagcaactgaattctcacttcacatgatgccctgccagcctcccctggattccaaaaatcaaaacatccttggatatccaagaccgcagcaacatcatagaagttacagcagccactcggtctgtaaccaaccaagacataaactaaatgagcaactgtttgagtctcttgtttcttatggggaagttttgagtactcaggttgcatcaagtataaaatgacagggaagggaatagatagagattccagatgcaacacagtcctgatccttgagggatcgagatgggaaacagatctgtttcatacagatatgaagcggtcagtcctgagagcaggcagttagtggaggtgcccagtgaggcgtgtggatatacctagaggaaagagagagctgattcatgcagagacaagagggtgccaccaaggagccttgatgaacaagaagcatgaggactggaggaaagagggtgaaaggcatgaagcagggaacctaagtttctcccagctctgccacattagagaccaagggcgtatgagcttctcacaccgccaccaccagagtgatcacacaccaaagggattcactcagcacgcagcgtgatggcactgccaccctccacaccagctcagcgaaaacccaacggacctaaagaccaggagaataaaagctcaaccaccctcccctgcctcctcaacccacacggatctctgactctttttttttttttgagacggagtctctctctgttgcccaggctggagtgcagtggtacgatctcggctcactgcaacctctgcctcccgggttcacaccattctcctgcctcagcctcccaagtagctgggactacagccgcccaccaccacgcctggctaattttttgtatttttagtagagacgggatttcaccgtgttagccaggatggtatcgatctcctgacctcttgatccacccgcctcggcctcccaaagcactgggattacaggcgtgagccaccacgcccggctaattttttgtatttttagtagagacggggtttcaccgtgtcggccagatggtctcgatctcctgacctcgtgatccacccacgttggcctcccaaagtgctgggattacaggcgtgagccaccacacctggccctctctgactctttttgcagccatttgagtgcctgttcttttttaccatttcagaggtattttatggattttttaaagagtacttctaatttacttttgtgttcctaatggtcatttctcaaatatgtagtagttggtaaccaaacaaactaaaaccatactaaaaatttttagtagttggtgatagtttcatgtcactgtaggaacctttttattttctattttacctgcctttgaacccttgcagaacttcactctatgttgattgaaaatcatttctttaatacttgtttcttgcaataaactcatttgctaaggtatatacttccatatgattttgtgtttcatgacccagctatattttattattgggtatcttaaagaaacaaaaaaggccttaacaataacagaattctacttgtgtcacttctttgtttttgttttcaaaatgccaatgtcttactaaatagaaacaaacttgatttgaattacgtaagctctaaccacataaaaaagatggactggtacccaaggtagaagggaaaataagcattttgtaattatggaggcagtattgcaaaatggttaagagaaggcctaaatatttgcagggctggtgcaagaaaatagatggaagtttgagacccctcgaccctacccctcctctcttctcaaacccaattgtgttctgcgggttaggggatgcatatagtcacgtggacatcccgatccacatggccacactccattcagcaatgctccctgctcatctttcagacccagggaaacacacacaagatcttcccaagaagatgaactccaggaaacaggctggtgcagcccaaaagatgctcagtcaagtttggaaaggcactctgggtgccccagcacctggggcatgtcctggaatggggatgggttcagctggggagggcaggaatggggcctagaaggcataggcaggacgctgggctgggggcagtgctcgatatgagcacagtgcagagccagatgagggatggaaatcagatctgccacttactccttggaaacctataaatgatcactttatcctccaagagccttagttacacatttgcacaatgaggataatattactgtagtataataagaactccatttgcccttgtctctcgtttctggcatggagctcctaaaactctgggaatttcccaagtgatgggagcatcttttgttctaagaaggcagcaggttggtgagtccctagatagcttcaggatgggggctaattgcaagaaagagtgagtcttgattagatgctcagaaccttcagccccatttcccaacctctcaggagaggagaggagctagaaattgagttgatccccagtggccagtgatttaatcaatcctgcctatgtaacaaaatctccataaaataccctgacggggttaggacagcttctgggctggtgagcatattggtatgaagagtgtggtgcaacccaatgctaaagggacagaggcggccaggcgcggtggctcacgcctgtaatcccagcaccttgggaggccgaggagggtggatcacgaggtcaggagatcgagaccatcctggttaacacggtgaaaccccatctctactgaaaatacaaaagattagccgggcgtggtggtggacgcctgtagtcccagctgctcaggaggctgaggcaggagaatggcgtgaacccgggaggaggaggttgcagtgagccgagatcgtgccactgcactccagcctgggcaacagagcgagactccatctcacaaaaaaaaaaaaaaaaaaaaaagggcagaggctcctgtacttggaatccttccagaccttgccctgtgcacctcttcatctggttgttcattcatatgcttaataataaactgtaatcataagagcatagcgttttcctgagttctagcaagttgttgcacctaaaaggggggttgtgggaacccccaatgttgtagccatgtcagacagagtgtaggtaacctggggacccaatacttgtaactggcatctgaagtgaggacggtgttggggagctcagcccttaaacccatgtgctaacttccggtagtcagtgtcagaactgaattgaactgttggacacccagttggtatcagtgttgaatgactggttggtactggcgaagacatgatgtatttggtgttgggaaacatgaataaaaaatttgtaaaacctccaaacgatgttcagcaattcacaaaggtgtcagtgcaagagttggcctgtatctattctaactggtcagtatgcaagttgaaccattgtttgattatctcctctgtctacaccatcaggcttttgtgaggattaaactaaattatgcctcagaaagaaaactctctcaaggctaggcacataatcaacactaaacaagtggtaatcattataattaagaaagtaaaaatatttcaaatggacgattttgatactgtataaaatgttgcaacttttttttttttgagacggagtcttgctctgtcgcccaggctggagcgcagtggcgcaatcttggctcactgcaacctccacctcccgggttccactgattctcctgcctcagcctcccgagcagctgggattacaggcacgtgctaccatggctggctaattaaaatgttgcaactttttaggaaaaataatcctcaataaataaattgctaattttcataagagccctttgtcaactgactaaaaacatccttaatttagaaatgtattttttagttttaagataactagtcattaagtgaaaacattgtaggcaaaatggctctaagcaatttagtattcataggaatgaatccattccttgaaagcattggtcgctgggtgcacttgtcctggatgagcagatattaggcaaatcagtctttcaccagcaaaccctgccataagaactgcacaggcctgattcctgccaagcacaccaggcccctgactggggcagaggcctcccttatggggcaggaagaaggaggcagggagaaacatagggcccatgatttaaggaggctctccctctcaggctcatgcaagtgcaggatcagtacctaaaggggagcaccgcccgaaatcctgtgccccagtcaccttaacccagtccagccctggctcctgcactccaaagctaagcagggaataccagcgggagacagaagacagcatgagaaactgaatgcatctcccacatttatctaaaaataagaaaatggacttcttcagtaggaaatggctcatctttccaaatgaataaaaatacttatagctatgggttgaattgtatcaattctctcccccagttcatgcactggagtactaacccccggtccctcgggatgtgatgatagagaggtagggcctttacagaggcaatcaaattaaagtgaggtcattagtgacctaacccaatgtgactgatccacttacaaaaaaagggacaagatttaaagacagacctgtatagaaggacgatggtgtgaagacacagggaaaagacaaaagaggcctggaacagattttcctcaaagccctcagagggaaccacttgggctgacaccttgatcttggacatccagcctccggaacggtgagatgatgaatttctgttgttttaagctacccagttcatggcagtttgttacaacagcactgggaaaggaaatcacctctatggagggacttacgaaagtcacttaactaatgcagattagaggcctcacagtcagggcatggcctcaagagccacatccattttaattgtaccatttctcactgaactctgaccctggtcaaggcatgtctcaggctccatggactactattccttccactgatcgaccctggcttcattctggcaagggagggactcatacattctgcggcctgcatgagtgtcatgtgagcacccccataaccttgatccctgcggtgcttctccaggggagccctagcattccagctggcctcatgggcatgccttagagagagggagctgaccctctccttcttcaactggattttatttttattttttggcatgttttgtgaatacaaagattcactgcctgggtgtgccccttgaaagaaggtttcaattgcattcaggtgaaataaccacaaaatgactgtaagccaaatgtagtagtatgatagaaaaatggaaatatcgtaaaagcaccagtctgtagacacctagcttctggttcctctggaaaagggagaagagagtagacagtgatggagaaaagaggggctgtgaagactatagaactgagaaggcagtaattctaaaatctccacactgtagggccaggaacaggcagtgctgggcaatggggcatcttatctcagggaagtcaagggtgtcatgtagaaccaacataattcatccaagtacagcaaagaatccagaaatggtctgtggaggtttggaaccatgaaaatcaaataggaaagatacaaaatatttacatatccacattttttaaaaggggtcctgactaggcagcataagattatttgggttctgttcattttacctttagttgcccttggttctgccatcttttttctctgtgagtcatttgtcttgcttttggtcaacacggctttcctcgggtctccaaagatcctggaataac

SEQ ID NO: 2629 - DNA, 67143 bp, Homo sapiens
gtaatgccaagaactttatatctttaatagtgtagaaaattgatgacacccatttccttgagaagagggtcaccctctggatacaaactaataccacacagagtttctggatttcattctcctcaaaatctctctgccccagtccacagtgggtgcgagtttcttgcctctctctcagctgccactcttctgctgaggcagagaagttttctcatcctctgggtctccactataaccccaacttgcatgccccaaagacacgcacacccttcccaaaaacccagcagttctctgtgagtctggtagaaagtccccattatttgtggacctactcagccttggtgagtggctggtcccaacaggatccacaagaaacttgcatgaccgcaaggcctgggcacaagacaaacccttccactgccatgctgccattatggctgttgtttttccatatggtctcacatggcctctcagcaggggacgacactgatgggatttttatgggtctgtaaataaagctctttctttcccactggagttgtaaactgagaagtagacacaagaatcagacagatggagatcaaaacgtcagctttgctgctgatcagaaggaggtggctggatgtggtttatgccttcaggttgatgggcttgcgcttatctgcttgtcccttctcccatctgatttcttgtggagcccatggaggtaaagttggtatttccaaatcagacattttgcccaaaattgctgcccctctctggttctgagtggaaagggaagaaaagaaatcaaatctcagttacttatagttttccagtagatcagcctcaccaatcatgggccatgagccaatataatctcccacagactgagacctccatcccccatggtgaggggctagtgagactggaatacgaagagagttgctcaagtggcattccctcctcatgtaattatgaggcacagggaagaagagggccctgcctttttgctccctgaatgcttaacctttagattgaagtgttaagtccctggttggccagggaggcaccatcttgctcttgcggctgctcacttggcaaaagctgcccctgccttcagccacccactccccaatatcagccactgtgtcttgagtgtcttccggggactactgccagggagtatgtattttgttctcagaagctgtcacttgggtcagaatagtaaaatattcaaattaagtttgagccacactgaagtcaaagttggaaatttattttttctttctttctttgcattcttttccaacaatattgcccaatgtagcttatctgagattctgcaatgtgattaaatgtcaacattaatatgatctgggaataaaatgccaacaacccaaagttgaatctaaacctcttcttttattaaattctcttttaataggttaggctaggttggctggctgtattctggaccctggggctctcaaatagcagcaaacaattcccagatctcatggcttaacactaggaaggtttgtttccatggacttcactggccagcctgggctctgccctgtgcctccctggtcttcactctggtgcccagctgagagcacagcagccatgtggaatgctgctggccgtgtgccagagggaaactgagcttagctaggcacacactggtgcctacagcttttcctggaagggaccatgtccctactggtcacatttcatgggccaaagaaagttacattgcaccacctgagttcaagagggcacacaagtccaatcctcccttgtgcctggaggctgagagctgaagtagcttgcaccactctaaggaccagcagagattctcagaaagaaattaaaagaggcaactaataaatatgcttggaagttaaagttcaaataattctgtgtcttcagtaaagtctaaaattaaatattcttgctcttgtgaagtcaaatccaaagtctataattcccagtcttatattaatgtccaatgaaattaaggccttcctccatttctttctctgtttattggatctctgttctctggatctgtttctctgttctctggatctcttcaacaatcagatgtgaactgggctacccttcaacatgatgtgcttaatgccttcaggacttcagaggatgcattaggttaggtcaatctctcatttcccacttgaaagagaagaaaatgatctttgcaccgccaagattctcacagcactgacattccatcaccagctaacttcattgtctagaggaactacctaatccaaacatgctctcgggacatcacactcggtaaaatcttggcccgtgttactgatgccaaatacgccatggaaactccatgggatctgagtgtaggttgatgtacagagaagaaatcatccttgtttttatctctgcaggatacctttggttgcagagcactgtgactggggcagttaactccattgcaagaactgtcccttcaccaaaccaataatggccctacttaacctgtacatattgtctccttccccagagaggtatttgttgagaaatatttgagacattgctatcttctttcaaagtatagaaatatacagaggtggcacactttcttttgcaccttgggtgtcatttcccctctagcccagtgtgtggagtcccctcaggctgctctgagagttggtcctctatagtgtcatggctgccactgaatcttacaggcatgtgtgcagtgctgtgacagagtgaactgtttctattgcctcttgttttgaaattgctaagacccgggaagcctggttccaggggacaatttccctctagtcctcatgttggttttcaatcaagaaccatccttagaacatttccaaaccaaagctgctgttattgcttcgagagtctttgctcccggagcaccactcctcacctttggctgcagcttggaatcccttgggggactttaagaatcctgagggccatactgtacccaaccaattgagtctttgggggtgtgtgatgactaattgtatgtgtcaacttggctaggccatggtgcccagatttttggccaaaagccagtctagatgttgctgtgaaataatgttttaggtgaaattaacatttcagtgaatgttgagtaaaacatattaccctccataatgtgggtggacctcatgcaatcagttgaagtctttatgagaaaaggctgagattcccccaaataagagggaattctgcctccatacaagcttcagcttgagccgcagcatcaactctgccctgaacctccagcctgtcagcctaccctgcagatttcaaacttgccagcctccagtcttgtgagccaattccttaaaataaataaatctctctgtctctatctccatcactatctctctatccctttatctctatctctgtctctgtttatctctatttctatttctatctgtctctatccccattcctatatctatctttatctctctctatccctatctccatctcgatctttgtctctgtctctacctctatctctatctacttctgtctctatctctatccctagctacctctatctctatttttatctctatctctcttgtcctatttccatctctatctctttctgttctatctctctctgtctctatctctatccctatctccctctatctctatcccttctctctctctatccctatccctgtctctctctatccctatctgtatctgtgtctgcatctctatccctgtatctattcctgtctatctctatctcgatctctattcctgtctctctatctctatccccatctctatctctgtctctatccctatctttctctatctcaatctctatcactatccctatctgtctctatccctgtctctacctacctctatctctatgtctatctcttctatctctatgtctataactagctctatccttatctctttctctatgtatctctacctctgtcttcatctctatccctatctccatctccatctctttctttatccctatctctctgtctctatctcctctatctcatctctgtccacttcctgttggttctgtttcttggagaaccctggtgaatacaggtggtgctgatcttccaggcactggtagtgtttagagctttcctggtgactacaatgtgcagcagggtggacagccccttcctgagggatctaaaaaggaccatccccctttttctctgcttcatcttttgttatttgtttgtttgacaattgtaggggttctctccatggatcgcgaccctctcctgcccctgctatttccagaaagtgcagtggcatttctgacagtagaacctcatcttaagatcattccccttctgtatcaaatgacttgctcttccatgccttgctccacaaactagcagcatcagtcttacctagagcatgacagacaagcctagatattgcacctactgagggatgatgtcctgaagtactgcatccacagctccactgttctctcagggtccatctgcagctcatcctccctttcacatctgcccaatctcatctcccttcctgcatgccctgcctcccctttgaaacatcagctttccttccactgaaatcactctccttccctccagtttaattagcctgactgcctaaaaaaaacaaacaggccagctgcagtagctcactctcataaggcgaggcaggaagatcacttgaggctaggagttcaagaccagcctgggcagcatagcaagaccctgtctctacaaaaactaaaaaattaaaaaattagcttggcatggtggtgcatgcctgttgtcccagctactcaggaggctgaggtgggaggatcacttgagcccaggagattgaggctgcaatgagtgacccatgatcctgtcactgcactccaggagcaacagggcaagaccctgtctcaaaaaaattataaaaataaacaactcttctacagctccttttcttctagtaaagtgaagtacactttcatagccttctagctcctccttgattcttctagcaaatatggcatctataaagtaatccagatgcaagacttgtcagtgcacttctaacctttgggttcacaaacactgaattaagttgtttttttgccactccactaaaaaaagacattaaaaaagtgctgccattccttcatttaattttcatggaagattcactgaaatgatctaatttctttgtctgtattttgactataaagctaatacatggctttattcttctttatttgttgatgattcaaatctactatacttctacaattaaaactggtctggaactctaaaatcgaaattcaggattacagtttatgcagctaaaaattgcaaagccaacttgagatcacacggtggtggtgattggggtaatggtggagtgatgtggtgatcatagcagtagtgggatggtggtagagatggtatgatggcagtatggtggtggcaggaagatgctcatggaggtgacagtaaccatgatggtggaaatggagcaggaggtaaaagttgtgatggaggtaggggtgggggctgtgatggtaatggtaatagtgatggtgatggtggtggtgatggttggtggtggtgatggtggtgatattggtgatggtgttgcctgtgatgctgtggtagtgatgatcatggtggtggtggtggtggtgctaatggtgatggtggtgatggaggtaatgggagtggcagcattggaggtgttgaggaggctggtggtgggaggggaatggttgtgacacagcctctggacaaggcacatagtaaggagggattcatccctcaaattcctctcaatgcctgcatacacctactggaatttgggacagtgaagcagggagtgtgggacagatgctgctctgttggcctggtcctaccgattcaaaacagaatatgaactcaccattgcctcctgaaccacacagagcccactgactattatttaggggccttgcctagaggccccactgaggtaatccagaaaggggcaagtatgttttcatcacaaatgccaagacagcaccaggctggctgctctcctggagtccaggatcaagctgcagtggctcccacggcagcaggcatgtgctgcaagccagattggaagcagttttgctaaggttcttccttattaaaacaagctctgttctgcactagctgctggctgtgagttcagagggcatgggtttatggtggtgccagtagtgcctatttgcagcggttccaagcagccatttgaccagactcccccagcaaccttttcaatctcaccaattcttgtttttcttggggttctcagctcatgtactaaaggcgtatggcaaatgccctctatacatacattccatacatgaaatgtgggagttttagggggaatttaagcaacacccctctgatgtcatttctgaggtatttgaatggagagagcagggcacgcagggatgaaaatacgagtttatccctgataagtgctggcttggaggacacaacttaggtgggcagtcagatgggctgggtgcttccttctcccccaactctcctctccccagctgtctagcccttggcacacttactccaggcttgtgtctccctaacagattcacttaccctggttgctggcatgcctggccattggaagaaagggaaatttcttcctttttttttttacattctttccctcaacaaactttattgagcacctagtaactgccaagccttgacaagacagaaaataattttgtttttctgatacttatgtttcagcggagacacaagtactctttgtttgattgccttttgctgaatgtgcccagttgaaactcactttttaacctgtgaggagagtgataaaaggacatactctttgggaggctgaggtgggtggatcacgaggtcaggagttcgagaccagcctggtcaacatagtgaaaccctgtctctactaaaaacacaaaaattactgggcttggtggcagtcgcctgtagtcccaactactcgggaggctgaggcaggagaatcccttgaacctgggaggtggaggttgcagtgagccgagatcgcgtcattgcactccagcctgggcaacaagagcaaaactccacctcaaaaaaataaataaataaaaataaaaaaagacaggctcctggagcttccttctcaggggaaggaggagcatccacttccccctagtcattcagagaggtcaaatgcagtcctctttgggaagtgactggatgtgcagagaaagtcagagggaggtctcgccgcctctcaggctgcttcgaaggatctcagtctgtggaccaatgggcttttctgcattcggctgccatggcttgtggcacattcagcaggattggtttctgacctcccatcaggctgggagcaccccaccgtgtatgtagctcaataccgagagatttgtaaaggtttttattgaatgactctaaggttctaagcctgggtaacttgggttataacagcattcataaatggaaatagagatattcgaaagacacttttttttttgagggagaaactgctgagcgcaggtttagacttcgtgagatgtttagaggacagcatattattttttgcatggctggatttaatggttgttttgcatccctttgcagggttgagatagcagaggactctcagaaaccctcacacccagcattaagaggcacacactagatcagtttgcagatacaaatctttgtggctctatactttctttaaaatcaattcccagtattttaaattcctcattattcctctatcatgtgttagacaaatatgatatccacagatctacaaatggctataactatgctgtcactgcagggatgtcttgctctctgaactgtcgtcaggaagcttataaataaatacgggacacatgaagctaatttgataccaacagcaataatataaactctgactaagggaaaattggaaagtgttgctgatctaacagcacaaagaggcattaggaacgtgcgtctgcatgtacctcactcccaggcttgggctctttcccataacatttggaggctgtgatttcacctaccaaatacctatttacatgcttagcctttggatcatataattcacatctctgagaaaatgatgtattgttacctaaatgtatcactgctaaatgagatcaactgaagagtatgttattattggcttcaaactatgagttggaaatgtccacacacttgcaccttgctttggtgctattatttgtttttgattttgttttgttttatgtttttgatgggagagtgcggggcgtgatgatcatggctcactgtagcctccacctcctgggctcaagccatcctcctgtctcagcactcttaggactgactacaagtgcacaccactgcacccagcaactgtttttttggtagttacagggtctagctatgttgcccagcctggtctcaaactcttagactcaagcaatcctcccacctgagcctcctgggtagctgggactacaggcactcaccaccacgctcgattaatttttatattatttgtagagatggggtttcaccatattgcctaggctggtctcaaattcctaggctcaagcggtctgaatgcttcagcctcccaaagtgctgggattacaggactgagacttcatgactgtccagcgctgttatttaaaatacaaactgagttctctacaaggtggaagttttaataagtgatgcaccttgtcagagtaaaagctttcagtgggggaaaatgtgctttaatttagttcatctaaatttctccacactctcagcacagcgattatcttgccttctatatcaccctgacacatactattaacctatcaaacagcagaaggctgagcaccaccaggctccaatctatacagatagttgggccaattcaggtcaaaattttattggttttggcctaaaagctgctggaaaaacttgtaaaatgaagagaagttacaatgtgattttaaagcggatttcaaagatgagaacaggataatatcagtttctggctgcaaagttttcttctgttaaaaacctataagttaaataggcacacaaatatatttctatgctctttaaactactgggtataaagtgatcacaattttaagttgcataaaaggactgcaaatattaaaacacttgactacaataaggttccttttgggccttaggtaagtaatgttttctggtgttgttccagaaagcataataaataaaataaaattatcctttgatcataccaaggggtttgtgacagtgtgtattagcctgttttcacactgctataaagaactacctgagactgggtaatttataaagaaaagaggtttaattgactcatagttctgcatggccagggaggcctcaggaaacttacaatcatggcagaaggtgaaggggaggcaaggcacgtcttacatggtgtcaggagagagagcaaggtgggggaactgtcacacacttttaaaccatcagatctcctgggaactcattcactatcatgagaacggcatgggggtaaccatccctatgacccagtcacctcccaccaggtccctccccgacacatggggattacaattcaacatgagatttgggtggggacacagagccaaaccatatcacagtgataccacaataagatatccataagtgtcagtttcttaaggcaattttccaaagtaccccacatcggatagttgaaatatctgagatgtattgtcccacagctcggaaggctggaagtcctagatgaaggtgttggcagggttggttcctttcgaggctgtgagtggggatctgctccagggtcccctccagcttctgggggttccttggcttgtagcaacatcactccaatctctgccttgtcatcacatggcctcttccctgtatgttcgtctgggcccaaatgtcccattttcataaggacaccagtcacactggattaagggcctatcctactccagtagaacctcatcttacctaagttacatcttcagtgaccctcttttcaaataaggttattttctgggcattgggactttaacaaatgaattttgggggaatctgatataaccgatcctaccccccacagtgatgcttgggcacctcagggagcacccccctctcagccctgcatcccagtccctcatcccacctcctgctcctggctttgttgtgccttgttccatctcacggcctcacccgcacaccgccattttggttgggctgtctgctttgtccctgaacgctaccttctaatcttcccttgactcctctcctgctcagagcccaggctgcctaaatcccagaccagggatcggactctgaggagcccccatttattcagtaagggagtgtctctgtccccttaataaactgttatcctgcttcttgactcatggaggaacagcaagtcctgaagaaagatgcaggaacaagggacccagaaacccagccaggtgggcttacggcatctgggaaactgtgttttggaacaagatttggggcctatttgtgagcacattgtcctaaaggcatttttgagcccaggataggtaaggaaatggaattctctgctgagatcactattaatatcttacaccacctagaaaaaaatggtgtctaaaatatccaacctgtcagacaaggagctttgattgaagatgcaatcacacagccaagccaatgccagctgacaaaaggagtttctggggtgggaaatgggtgggatgtgtccagggatttaaaacccaatccttgcaggtttaaacgaagtatgatttttgacaggaggttctcagtggagtcttgtatttttctacaatttttgattagggcctcatggactggaatctacctattctctgtctggagtcatagggtgctagtgggtaagtgtgatgttttcataggtagcagttctataaggtctcctgtacagtcatctgtggtattttcaaatgtttacctctgctctataaagaatttgggtcacttttgactatgtaagactttggtctgaattatttagactaccacccctactgcagtagtattttagaattccttctacaacttcagtggctatgacatttactaatcttggcatatgatttctgaggaagggttgcttaaaataaatacctaggcgcccagatacagaatttagctatggtgaaatctcaactgttcagtgtctcctgaaaatcagtgatatcttctggatgaccaaattgaccaaacacttgaaggctaaacttattcttccccagaacattaaaatctaagtttcacttgtatcgtattttgtttttgctggaagtgtgggctttcttttaaaatagctgacatcaatcaatcaaaccagtttcttaatagtttatcatggtccccgggcactccagttattttgtcatgtttccttgtggctccggttgtattaacagatgcaaacttgcatgtagaaggtgtgagggcacagagcatgttgcacatctgtatagagcttgctttcatgggaatctgttgatattaatttcagatcatttttcttctcatcaagatgaagtgaggcacacaaaggccacttggttgaggtcattccccagcctctctgcagacttagagaatcaagccctgagtccatcttccacggagtgtttttcttaccttcctaaaagagactcatcttctgattagcccagttacctttggtatcttggacccatctatggcttggatctactttcccatctctagttctttatgaaaggttcacgaggatttttttctcccttctacagtaatttgtgctaggagagggtacagactgactctagatcaggggttctcactgggggtgattttatcctcttccttggggatattgagcaatgtctggagacattttgattgtcatgatgagggggtgaggtgctaaccctaaccctaacccacctagggagtgagtggaggtccaggatgctgctcaacatcctacaatgcacaagacaggcccccacaacaaagcattatccagttcaaagtgtcaagagagttgcacttgagaaaccttattctaaagaaaataacactttggcaacataaactgagctacaatctctttcaacctctctttatctgtgataattcagagtattaacctctgttagcaattgcatcttaatattaaagttcctataaaatgcctccctgatggataaaccttttcatatagtttcttctctaacacacgcttcgtaaagcatgataatccataggttgaatctagtaaaggcaggaagtgaaggtaggatgccagttaaaataaatacatgcaatgttaactctgcaactggaaggagaactcagatactgtcttgcgctggttgagacaacttttttcaggtgtcaggctggtatctgcattagtttcccagggttgctgtaaacatggacacaacttgagcagcctaaaaacaatagaaaggctgggcgcagtggctcacgcctgtaatcccagcactttgggaggccggggtgggtggatcacaaggtcaagagatcgagaccatcctggccaacatggtgaaaccccgtctctactaaaaatacaaaaattagctgggcgtggtggtgcatgcctataatcccagctacttgggaggctgaggcaggagaatcgcttgaaccagggagtcagaggttgcagtgcaccgagatagtgccactgcactccagcctggtgacagagtgagactccatctcaaaaacaaaacaaaacaaaacaagcaaacaaataaaaccaatagaaatgtactctctcacacttctggaggccagaagtaaaaaattcaaggggtcatcagggccatactccctctgaatgctctagggagagtcctttcttgcctcttcagctgctggtgttgccagccatcctgggcattcatcagcttgttgttgcatcactccagcctctgcctgcgttactatttggacttcttccctgtgcatttccaaatctctctcttgtaagtcattggatttaggactcattctcatttagtctgacatcatcatactgtatctgcaaaggccatatttccaaataagttcacatttataggtactccatggagattagaacttggacatatctttctgggtgacaccattccacccacagcagtcagtagccaggatgtatgaggcactttacttccccacaccacagaagtccttttgtccctgtcaatcacgcaccgtctgtctctggcagtggcaatgttgttgctgagtcagattgctggtggcagggttgtcatttgcttgtcttcatcatgtatttcagcctcctgtgtcttttcctcctctttcttctttattttcccatcaattctccttgtctgcctgattttaccaccagaagctaatcatgatgcactttcctttatgataaagatgctcaccccattcactgagcatgggatccgactctttggatcttcttggtggtattcatttgctgcccattgcctgggagcacctggtaattgcagaagatattttcctctaagtgcttaaatgctggcagtccttaggggaatctgaggcttccataaaactggacttcagatgacaaagccatgctacattaatagctctagagatctgcagttgggatggcttatctttcagatgccatcattttggcttttaatttgtttgcgaacaatatcctttggggagctgcatccttcaacgtctgcctgcattatcacatgggcttcttccctgtgtgtctccagatctccctctcataattcatcggatttagggctcaccctaatttagtttgacctcattttgattatatctgcaaaagccatgtcttttacctgagggtaacagatagtaagaacttgtgggcatcacctaagagcagggagtgaaaaaaccaactgaggaaagaaaaatgcagggcccaaaaacctttttaaaatgtatttatttatttgagacagtcttactctgttgcccaggctggagtacaatggcatgatctcagctcactgcaacctctgcctcctgggttcaagtgattctcctgcctcagcctcccaagtagctgggattacaggtgcacaccaccacgcctggctaatttttgtattttcagtagagacagggttccatcatgttggccaggctggtcttgaactcctgacctcatgatccacccacctcagcctctcaaagtgttgggtttacaggcatgagccaccacacccagcccaggaaaccttttaattaaacaatgtagtcgaggtctgtgggaagaggcagaagggataggattgtccccaccctctgtcaatgttcaacagcctgaaacccccatcttgttgtaaccctgatgttgctgtgtcactgctcaagcagaaatacagaatgtcaataccagagcaaagatggactcttgagctgtgttctattggtggaaccaagggctttagttggagctacgaaagcggcataagtatacagaggagtctagacagtaagcctgggcaagccaggcaatgactggcagaaagacaattattattcctgccgtgtgtgcaagtgcgtgtttggaggggaaagatgaggtctgattgtcttcaggctttccaccagattagtgtttcccatgaaacctggaggttcatggacgtggtcttttgggggatggttccctgggtctttttttgcccttgtaaaatattgacaggtaagttttcaacaagaatgctgctgtcgtctatcttgtttaagattgccaccttcctctgcctctgaaatctccataccacttctgtgctttattttcctcctaaacataatcattttcaaatatactatatatctactcatgaatcttgttgattacttccttctccttaggacgtgagctccacaagggcagagggtcttgtctgttccattcactgctgtgtcttccgtaaatgagacacatggcccctgggccatcctggcttcctcatccttcaacccttcaacctgcacatacttgttattatgtggggtgtgattttactagagggaaccattcgatgttgcacatataagggatttgtaaaatgggaatagcaatagtattgagccgatgtggctgtcgtaaatgagtacctgtaaacaacagcaacaacaacaaaaaaaacccagaagcagcctgacctagaatgagtgcttggcagtgtcagcccactcaccaagaccctctgatggtgcttgctcaagccctggtgctctgctgccgaaaggaatccatatgtttgggtttccaccaagctgaaatcttaattagcataatatgtaaaatcgtgtcagtgttcagtttttgctcccttcccccgccccccgtttatatttccttaacttttggtacttggtcattgcttctctgttagggaaactactaataggagggaaaaaatgctaaaaatctttcagggaagggggaatgatcatgcttagttcaacaacttgcatttttaaagatttatgcatacatctggttttgttttctttaaaattatccttggctttataaatgcctatactcaatccaattgaatatatcaatgtttcctggtcttccataattgcatcatgaccccaaacacttagtccactcactaatttaattgtttatgtctggccatccaggcagacccatgcccttggtatgtgagcatgcttatgcataaggttagcactaacaggcgttagatgctttcagctttgctatatgttgtaaaactaatgatgatttgcagaaatgagtaggaatatacaattactttatggtcaaaaatttgaaaaaatacttgttttggctttcactgacactatgtaattggaaaaaaaaggtgatttaagaagaaaattgatttacacaaatgttttattaaggcctttgatttccatgcagaagggatattgatatattacttattttttaattgccaaatccttagtgaacattaaatgacacaaaaaaggattgtggcaaattggatctggaaacaagagttgttgctcttttaagaccaaaggttgactgagccataacttgccaaggtgattggagcaaagtagatgtttattcaattatttaactcaataaataattatgtgctagttttgttcctggcatattgtgtacacatggctgtttgccatccaagagggtatatagtacatttgggagttattatcatgtaggtcgagttggaaatgtaaagcgaatgaacatgtcttgggagataatgtagaatgaagagaagacaccactgtctttggatgggcagaccagctcacaaagaagatggaggaaatgatggaaaatgacaacaggagaaagtgtggtcttatagaccaagggaagagggagttcacaaaggaagaaacagtcagaagcatcacatgccacagtgagggtcaagtgagagtcagttgctatattgctatatttgttgctttggaataaggagggctgagtaagctataatgagttatttgggctgaagatgccaaacttgaggtcagtggttggaaaaaggaataaaactctgtgtctcatctgagtggccaaatgtgcctttgccatggcagcacctcctgctccctcacctctctgttatgcagccaaaatataattaagtgtatgattgagatatgctcttttttccttctgagcacaggatttctcaaccatggcacagttgacattcgagacccaatatttctttgtggtagggtatgccctgtgcattgtaggaggtttagctgcatccctagtctttgggggccaggaccaccaaactactgccccaaagttgtgacatccaaaaatttcttccagcagtgccaaatgtcccctgggggtcaaaactgccccaggcaagagtcattgttctagatatgtagccagggagctcaagctgcttattttgaaatgctcatcaggatagaggtgcggaacaagcagattttagatggaaactgtctcagccagaaacctggctaagaaaaggtgcgtatggtgatgaaaaccaaataaccaagtaactcagaccttaattatttaagcaaagtttatctcccctgaagcaatgaaggaattgtctctagaaggtcaacacaagactgtaaaagtcaataataaaagattgctcctagtcacatacacacaccttcataaactaaacatgaggaagcaagattggctaatggtgatggcggtttgttgtgggcatgtggttagcaggaccctccacctctctgaccataacgccctttggtcttcagtagttgatgacaataccagctcagagtcatataatttgttctctacctcatctctgccttccacagagcaaaaattcaggtggtcctagttttaaaggtagagtaatattttccccctttctcccttttgttctccacttggtttgtttttctgctttctagaatctggaggacattcctggcccttagcagacttattttccccttttcttttgcttaatctaataaggcaatagcatgtacaaaccatccagcgagaattttcctctcctacagagtgtgcggctgtgactcaggatttggtgtgtggttcacttagccagtcaacaaacaatggctgcaactctgttagcactgtgctctcacaggtgagacaggtccatgctctagacaaaacagttggctgccatttttcatttgaacaagttttgttcaacttgggggtagagataataaacaagtcaaatgtaaatttgaaagacaaaataaatacaaattataatcattggcagaaaaaaagtgaagtcctgtgatgggtttgagattatcctagattattttagtgggtccaatctaaacacacaatcccgtaaaggtagagaatcatctttcccagctgaatcagagagatgagacagaagaagagattcaaagcgtgagagtaacttgccccgcccttcatggctttgaagatgaaggaaagacgctgtgagccacagaatgtgggtgacccctggacactgggaaattatctcagctggcagccattgaggaagtgagatctcagtcctacagcttccagaagatgattctcccactaacctgaatgagcaaggaaacggactttgctttagagccttcagaagggagcacggcactgccaatgccttggctttaacccagtgagactcatgccagacttataacacatttctgttgtttaagctgcaagtttatgccaatttgttacagcagcaacaggaaactaatacactgggcttggtggctgagtggatatggaggagggggaggaccacagggtggactcctagatcagccagagggcaatgagtccacataccaaggtgagaaaactcagggagaaatggactatggagggtggaaaccagactgacgttttggtcatattaaatttgaaatgtctataagacatttaagtggagatactagcaggcaattgactatgtaagtctagggttcagaagaggagactgagctagtgatgactttctggactagaagaatacagatccaaggcaggaggatcacttgagcccaggaattcaataccagcctgggcaacatggtgagaccccatctctaccaaaataataataataataatgagaagaagaagaagaagaagaggaagaggaagaagaaggaagaagaagaaggaagaagaagaagccgtgtatagtggtgtgcacttgtagtcctcgtaattaaataccagcctgggcaacatggtgagaccccatctctaccaaaataataataataataatgagaagaagaagaagaagaggaagaggaagaagaagaaagaaaaagaaggaagaagaagaagaagccgtgtatagtggtgtgcacttgtagtccccgttccttaagaggttgaggtgggaggatcgcttgagttcaggagtttgaggctgcagtgagctgtgatcgcaccactgcactcctgggtgacagagtgagattgtccctaaaaaagaaagaaagaagacaggtgacaacatgcaacatggaactgagtggatgtaagaagtgagtgtggctggagaagcaagactaagtccaaatcaaagacaccacagtatgtgaggttgggtgggaaaggaggaggacatggcaaaggtgtcagataaggacccccagtagggcaaggagaaaaccatgagagcacagcatcagaagggccaggagccaggcatgggctgcaacggaggatgtgggcagctgagaggactagtggaagaatgacagacaggtgccacgaatttggcaatgttgaatggatgctggtccttggtaagtctgcattagtagggtggcaaggatggaagccagatgggaataggatgcggaggcaggggtgaggcgattaaattcagacaacttgttcactagaaacagaagtggagagtggatctagaatgggtgagagtgaagagatggcttttaaagatggatcaaagaacaaagctggggtgtcacattacctttcaaatttattacaaagcggtagtaaccaaaacagtatggtgctggtgcaaaaacagacacatggaccagtggagcagaatagagaacccagatataaatccacccattgcaaccaactcatcttcaacaaaggcaccaagaacttacaatggggaaaagacagtctcttccataagtggtgctgggaaaactagatatccatatacaaaagaatgaaaatagccccctatctctcatcatacacagaaatcaaatcaaaatagattatagacttgaattttagatctgaaactatgaaactactagaagaaaacactggggaaccaccccgtgacattggtctgagcaaatatttcttgtgtaagttctcaaaagcacaggcaaccagagcaaaaatagacaattggaattacataatgctaaaaagcttctgcaccacacaggaaacaacaaactgaatagacaaaccacagatagagagaaaatctttgcaatctaactgacaagggactaataacctgaatatataaagaactcaaacaactaaatagcaaagaaacaaataatttcatttttaaaaatgggcaaaaaattgggacaaacatttttcaaaaagaagacatacaaatggcctacagttatattttttaaatgtttgacattgctaatcatcagataaatgcaaatcaaaaccataatgtagtatcatctcactcaagttgaaatggtttgtataaaaaagacaggcaacagcattaaggaaaaatagctaatgcatgctgggcttaatacctaggtgataggctgatagatgcagcataccaccatggcacacatttacctacgtaacaaacctgcataccctgcacatgtaccctggaactaaaaataaaaactgaaagaaaaaaaaatgaagataaaaaacaatatgcactattcaaaaaaaaaaaaaaggcaacgatggatgctggtgggaatgaagaaaggggaattctcatacgttgctggtgggaatgtaaattagtacagccactatgaagaagagtatggaggttccttaaaaaatagaaaatagaactttcttatgaccctgcaattccagtactggatatatatctataagacaggaaatcaatatattgaatagatatctacactctcatgtttatctcagcactattcacaatagccatagccaaaatatggaatcaacctaagtgtccacaacagatgaatggataaagaaaatgtggtatatatacacagtgtaacattattaggcccttaacaaaataaaacccctgtcatttgcagccacatggatggaactgggggccattatgttatgtgagataagccaggcacagaaagacaaatatcacatgttcttatctgtgggagctaaaaagtggatctcatgaagatagagaatagattggcggttaccagaggctgggcatgggaggagtacaaaggggtaaagtgggaaaaaatcattaaatgtctttaaactgtacacttaaaaatggtaaagatgggctgggcttggtggctcatgcctgtaatcccagcatattgggaggccaaggtcaggagttcgagaccagcctggccaatatgttgagaccccattctctactaaaaatacaaaaaattagctggacatggtggtcacgtgcctgtagtcccagctactcaggaggctgaggcaggggaatcacttgaacctgggaggcggaggttgcagtgagccaagatcgcaccactgcactcctgcctgggcgacagagtgatgagactctgtctcaaaaaaaaaaaaaaagaaaagaaaatgtaaagatggtaaattatatatgtatattttacctaaatttttaaaaaagatgagtcaagtttgtatactgatgtgaacgatctggtcggggaggataagtggacctggagagagagagagagagagagagaggaacagagagatagagagaaggggagagagagagaggagaaatgagaaagacagagagagatagaaagagagagagaaggaagagagagaagaggaatgagacagagagatagagagaagggagagagagaggaggaatgagagagagaaaggagagagagagaggaggaatgacagagacagagaagggagagcgagagagacagctaagggggaatgggggaatgaaaggacagaggagagacagaaataatatttggggagagaatatttggggagaatataggagatggaccccaaggcacacgcggaggaatcagcccatggcgttcactgtagtaggaagggaagctggggagatggatctgtagatttgtcagtgggaggcggatggaaaagaataaaaattcctggcagcacgccagctcggccttcccacattagtacggccgtaataacgacttgggagtaataatccaaaaattcggatgtggagagggagatgacactgcatcactttgatccaaatggcatttttatgatggctttaaatatgtttatgatgtttacaaggagaaagtctagaatgctgagcaaaaggatgcctttgggaaaggacattaacattttgctgacaacaataacccccatgcttgcctctctcctcccccaggccttgcactccttctagttcttttgttgttccacacctgcaaggttgaccagctgccccacatcaggggactcagctcttgaaggtgttatcccaggaatggtagtaggtctttctgagtcaaatcaatgtcctccaatttgacttccaagtgaacttgtaagcagagatactcattattcagctgatagtgttaacagagatggctcagattctagaattattcctgagacaggctaactggaccatctgcaatgattcatatcatgcgtggtcttcaggagtccacaaggagaaagaaaatatttaaacttttatgctagtaacttttatctcattcttttaaaactgtatgttgcagtatataaaagcattaatacaataatatatgcatacaatttatgtctgtatacaatcatacagtggtgtgatcaaaacctttatcctgaaggaagaatgtggtctcacaagcctacacacacacacacacacacacacacacacacactcacacacacgaccatgcatggcggttgtgagatagtaacgcaatggattttcattgacattcctattggtggttgtcctttcaagagtctctcctggtgggtttggatcgtaaagcacttgctgcagcttctgagctgtcacgtggtgctggcttctgaaggaaacgtttgcacctctgcataatgtttgagctaaaatgatgaccctacgatagtcatactatatattaattggcatatagaatgttatatatgcctgcagtgcacctttctgcagtgactaatgggcctagagaggtggcctctctgcaggagctgctcaaggcaggtgagcatggctatgttcctcaggaggacatcacctatttatagggccctgcattctttctggtcctcagcaaggccatttgtgaattgaggcaatcaatatcccacccacccgaaccccatgatttcttagtggaaatagccaatatccattctgagtttactcagtgccaggtgctactctgcattagtgctctaatgcagagaaacttatggtaaagataaggaaacagaagcccatgtggtcaggatttgctcatagctacggagtggcagaccgaaatttggtttcatctagtctgtctccaaagcccgcagtctgaaccatggtgatttttgcctcttgcactctcagctgcttgcagctgcaggcacaatgattccagatttacaaaggcccgcaagtttagacatccacatttacataatgacttaaggatttgcagatgtctgggaaaaattatcctgctcacttggattattgggactgtgtctcaactttccattttattttgcacgtgtgcacaatattttcaggtaatttctatgaaataatatcctgtcacatagttaaaggttataaacatggtgctttacctttgtttttgccttaatggccaaaggaaggaggttagcgagtgagcacatttgctccttttatctgcagtaggagcgttttgttggaagtatttccatgtagcagcatgaagccaaataagacatttacaaacagttttttttttaagttaagatatatgtttcatctcttgtttcacattgttgcactcaatatttgcaattgagttagcttaaagtaaagtgcatttattcgactagatggtttgctccagttgccccactgtgtttttttcttctatttgattgctgtcttggtactaagccagtacaaagacaggaatgaagatttacaaagttttcaaagattataatgggcccttgggtgtgatattttaaataggagctgactttaagtcaaaagctttcaaatcaaccagtaagtacttaacagaagtcctttcttcatgacaaggatgaaacacagagtggattacgcaaggtgaatctggtcagcccgggcctgaggtcacgtctgactcccagcaatggtgttttgcttggagacttctactgccctcttggcccctctgtttgacctggcatggtccatctgtagtcactctcataacatgtcatacattcctacacattctcattttctgtgctccttcaactttttttttttttttgagacagagtcttgctctgtcgcccaggctggaatgcagtggtatgatctcggctcactgcaatctccgcctcccgggttcaagcaattctcctgactcagcttcctgagtagctgggactacaggtgcatgccaccaagccgggctaattcttgtatttttagtagagatggggtttcaccattttggccagcctggtctcgaactcctgacctcgtgatccacccgccttggcctcccaaagtgctgggattacaggcgtgagccactgcacctggcctcaacttttattaaaaaacaaacaacaaaaaactgaggcagggccctgcctggtacccctgacagccttcggaagaagaaaacaggccttctctgtgggtcatgtctccagggtgtgcaggaccaaatactgctttattcataaaacaggtagctggaaagctgccccactgagactaaagggaatggggtaaatcatcctcccttcatttggctgtggcttctgacaatctagatagttgtttgcatacctgtgtgcacacctgttgtcattctgtttggacagatgactagcgtacaatacaggttcttcagaggatacgtaattaatcaaatcataacaacctcaataatataatctgaagaattaaaagcagggctctggtatttgttctacatagcattcatataaatgtccgattgctctttgcagcttacgcttggtagtcccaatcactctctagaaagggcttatgagcagctacctggaaggcctggattagggagtggtagcagatgtcatggttgagaggatctaggggaccaggcagataccccatcggacagtgggcatcctctaaactgtctctcactgacttcactatgaaccacagtaccataattttggtctttaccattttcaaaattttctgtttttcaaaccacaggttcaaactctatcgtagtttcagattagtagtccatgtttttcttatgactccacttatttaagaacttcagtgacatacatttatctccacgtagtgaggataaaaaagttgagaacaagaagctaatacgatcatcaagacacagtcacaggaagtaaaataggaaggaaggaaaaagaaaggtctaggtcttcagagacaagggagagatatggcaaggcagaagtccctaagagttcaatataaagacaggtaataccaccactcttaaggaaaatattcccagggattcaaagttgatcggttccatgtgtctaaaattcacttggacttgtaagagaaccccaactttaatggaagaagaaaacaggtaaaaatatcctcagctcagggttagtggcttttcttatctcaaataaagggaataactcattcatgttgctgggctttctttgtcctgttttaagaaatttcaagttgttggctacccaaaagctgcattctagacttcttcctcttgtcccactgggtagaagcatggcctgatattttccttcttcagtataataatttcattttaaggacagtcaggtcctctaaatgtgttattattttggttcaggctttaaaccgaataagccagccaaacattgataaaagcaatgtatctgagcttcccatatttactcggcacccagtgacatttggctcttatctactgagaatatgagagtgataacagtaggaaacttaagtcagagcctgcaggttcttatttaatatctatagacactaaaggatttgcatctggatttaaaaggaattactctgagaatatttaattccaatagttggaggaaattgctcctgtgatcagtacaatttgccacagttttaaacatgtgggtgacaatgactgactttcatatttctgtcctcggcagcgtgactgtacacaactgagtcgcagccactctcagaggggattgcagcctgcagctcacgtcttagagcttctgaatgcagcagagaaccaacttgctgagccactatcattattaacaaaacgttggggattttaaaagaatcctcagagagtcccagcaacatattcaatatggaatgataagggccaggcctttggagagttgaagaaaccattttcccagtaaacccttacatcaaatgtaccagtgacatctgattgcgctgtttcctctcttggaaatgctcttcccctcctcctcacctatagaaatttgattcacttgtcacaactgaactcgaatcctgcctcccccaccgagccaccctctctgaggtttccttccctgactccagttggaacgagtcctttcctacttaaggctattatgatatgaccctttgtccctaacacactgtacttccaaagcacacacgggtttacatgcccgtcctctactgcatgccagactgtcactcactgtccttagtgggggcgaggttctgcattagcaggaaccagaacagcaccttgcatgtccttaagcggccgggttttggggagctgaatctgttcatgcacacttggccttgtcctgttctcaaagctgctccacagacacggggctgtctcctctccgtggatgtccctggctggggcagcttcttttccatgcatcagcctgtagcacgatgtgcagtcttatgagcagtaagaataaatgtaatgtttcttacccagcaaccgcagaatgtgcacagctgcaagcagagtgtgtgcatgtgacagtgtatttgtgtaattgtatgtgtgtatgagagagagacactgtgcatatgtgtatcagatgtaactatctatgtcacgtaaccacatattagacttaaatgttactgtttcaagtttttaatattaaaaagtagattttgaggtcaggcgcggtgtctcacgcctgtaatcccagcactttgggaggccgaggcaggtggattgcctgaggtcaggagatcgagaacagctggccaacatgatgaaaccctgtctctactaaaaatacaaaaaaaattagtcggacatggtggtggatgtctgtagtcccagctactcgggaggctgaggcaagagaatcacttgaacccgggcagcggaggttggcagtaagctgaggtcgcacctctgcactccagcctgggtgacagggcgagactccatgtctataaaaagaaattgattttgattttccttttgtgcttgtcctctgatgtcaccttcctccccacaacacacactactgttgttaatttgttcagaccatgggttcctgactcacaattagaaagtggaagtgacagtagaaacacattgctttcactctgagcgcccatggtgggctgttccctattttcaggaggtagatgttcatgcgggaatactgctttgaggactacatgccttgagttcagaaaataagtttgatttaacgcgccccccgcccacccaccgccttttgttttgcagagaacgaagactcagtcatatcttaggatgtcttaggcctgaacctgaaaaaggcttccctgctttatgtcatcatcagtcaggatgctatctccctttatcttttgtcccgtgtgctgggaggacatggtccagggtgaaatgaaaaacaaagtgaaatgcataactttatttgcgtgtttctaatcatcctttaacagcaagaataatacactgtattataatagtcaaatttactctcttgagcttacttcatctggagaggtctactgactattttggtaactcttgtaagatttttcactagctcaagcagcatctctcaaagtgtcaactgttcacctttcactccagttcatgctgctttttctggctgtgctgctaggctgaatgcatcgctaacacccgcacaggggacacagcagattttagcagatgcctctgtggtttgcaatgggagggagcacttcccatgtgtcccaaatgaaaacaagcagaacttcaggtatgaatatatatgcaagtacatacaattagaagaatatgcagatgtacacatgcctcctgggcacctgttttcaggacagaaaaggaaagagtcagatcgtgtgtctctgcatgagctcaattgagaaaggggttccctcaccaaatattcaactcattgattgttgcaaattctgagctggatgctaatgaggaaatcaaacactggctccttcatcccagatttgtaaagcttattactgatagttttcagtctttccgtcttctaatttataacccaacttctaatgttcaagtcactctgctctgtgcaagaatctacccctccatggttgggagactttggcaaacccaatcagagatgaggacaaactgaatcagcaaaggaggtggtgctgaccaggttctgacccagcagcatgtcttgggaagaaactaagcccttcctcaatacctccccgccaagctggcactgctcattgactcagatcacaaatcctgggtaatctgggtggagcatgttgcccaacctcagtgacatttgctatttctatttttggaatagagcgaaaggatccaggagatcaattcggcttgatcctgttttttcctttctagtcaacctcctacagtgtgagcaatgaccctcactccacccccaggcatacacacccccctctacatcccacaacttaggcagtttctaagactttgggaaaatccctgggagttcctcataacacaaaatgccttgggctgtacaagcctaggagaagatgccaagctgtggtctaggctcagggaatagtttcgctgccccttcctccccacctccctacagacaccccccaccagccaagcagcctgttcccactgatgcctgactggggaaggagactgagtttgttagggccaaggccataagcacttatcactcagcaaccacaaaagcaactgggttttgtgttgatccctctaagattaggccttgaacctcctttgtgcaccccttcccaacagacaattgtacttctgtctgaaagttttaattaaatgactcctgcacaagctgtctgatttcaggagacatagcagcatctattggatcaacagttccattgtttgaaacatgaggactataaataggaggcagaaactgacagcacatttagtgtgtttgcctatgtggtaatggacatgaatagtatgggcactgagctggtgaacaacagaatctcaaaaagggaagaacacatttgcccaaaacattaatcagtatcaggctggcaggagagaatcaaagtagcttctgtggagagaagacacctcacccagagataaatagcttgcaagtattagaacattcacagtgaaaattaacccatttcctttaaaaaaaaaaaaaacttttaattttgagatacttttagacttacagtaaagttgcaaaaatagtacagagttccgtatccccctaatccagcttatcctaatgttagcatctaacaaaaccatacaaccaagatgacgactaagaaattaacattgatacaatgctactaactaaactgcagactttattcagttttctccagtgtttctgccacggtcctttttctgatccagagccaatccaggatatcaccctgtatttaattgtcacatctacttggtttggtccacatttttattactggttgtattttctgcacttttttgttctttgagacagagttttgccccttttgcccaggctggagtgcaacggtgcgatctcagctcactgcaagctctgcctcccaggttcaagcgattctcctgcctcagcctcccaagtagctgggattacaggtgtgcaccaccacgcccaggtaattctgtatttttagtagatatggggttttgccatgtgggccaggctggtcttgaactcctgacctcaggtgatccgcccttctcggcctcccaaactcctgggattacaggcgtgagccatcctgcctggccattttctgcattctttctacacttattaattgctgtttctctagaaggaagtgttattccttctcccccatttatttattggttttttccaaggagacatgacaattaaaaacagggtgatatcctggattggatctgtgacagctccttggtgttccctttactttcatgaccttcttacttttaaagagcattggtcggttatttcatagaacgtccttcagttttggtgtgtcttatgttttctcacgatgagattgagcttgtacattttggggttgaataacagaggtgatgggcccttctcagggcatcaggtcagagagtacgtgatgactatctgttttactattggtggtgttaacctcaatttttaggctaaggtggatggagttaacctcgattactaggctagggtggtgtgtgcctgtcaaaattatccactggaaagttcctatttttctttttgtgattaatagacatttatgttgaagggggtcctttgaggctataaaaataacttctttttttttaaattttgctcactaattttggtatccatgtgtagatcttgactggagaaatttttgttactggttgtattttccacattctttctacatttattaattgcaatttctctagaaggaagtgttattccttctcccccatctatttatttattcagttacttatttatatcagtatgaactcagcattatttattttattctttggataagaatgcaataatgcaatactataacaatttattttcctgatcaaattgtttcagctttggccgctgggagctcttacaggctggctcgtgccccctattgcaagcttctatttcttttgtttgactgcttctttactctctggtaccacaaatcctctatgctcgtcttatatattctttgctccagctttggaattaaccaatacttcaaaagtcctgtttccttttattgcaaagtcaaatttagaaccaagatctgggcaatagatgtgctcattgctactagaatgtcatttccactaggtcatctcagcagacagaactaggaaatgcatgtcatatgtaccaacccatatgtatatatgtatctatgtttatttctgcatatatttatctgtttatatattttaagtaaacacaagtttgtattgatactttggactccaattcagcaccacatggttcactctagccttcttccttatttgtaatgcctttccctgactgtgagagcctgactcacagcatctaccatacatttcttgttttgctaactcataacccagagacaaacaaatttaccaaataaaatacagcatggagtatagttcttgttgtctttagccttccagtatcgagtcaaaacagggtttccaaagatacctaggtcagctcttttgtcccccacctgtctcagtgagccttggtgattgattaatttctgacacagttgggtttctttcttactgtctgtgtttcttctcaactgcccccccttccattcagccaacatgctggttgattttaaaaatttaacttacatataacaaaattgtaattctgtacatcaaatttgtatgtcactctttgtgacatatagttttatgcattttgacaaagtgatagtcatctatttactgctatagtttcttagagcacaattccattcccactcccctaatttcctcatgatccctgcttgtagtttgtcctccccaccatcactcaactcatggcaaccactgatctgttttccatcttataaagatggaagctgtaagcttcacctcttccagaatgttgtataaatagaatcaaacaatatgcagcctttgggatgaacttctttcacatactgaaaagaatttaagattaatccatgttgttgtttaaattaacaatttgtttctatttattcctcagtagtattccatgatacaggtgtaccatagtttatccatccttgtttgaaggtcacatgggttgtgtccagcttttggccactatgaataaagattctatatagatccacatacaggtctttatgtgaacatatattttccttttcttgggtaaataactaggattgggattgctgagtcatatggtaggtgcaagttgaacactataagaaaatgctcaactgtttatcaatgtggttggccatttttgctttgagcgaatagcaacatatgagagttccatttgctctgcctccttgctggcatatagtattatcaagatttatggggcttagccattctaataggcaggcagtggtattaccttgtggtgttatttacatttcccaaatgactgatgatgttaatcatttttcatatgcttatgcaccatctttatttacatgcctgtttagattacttgcctatttaaaaaatattgggttgttcattttcttatttttgagttttgagagttctttattgtattctggacacatgtcctttgttagaaatgtgatttgcaaatatcttctcccagtttgtggattgtctttctaattttttaagcgtgtccttttcagagaaaacatttttaacttttataaagtccaactctttctttcttccttttctttccttttttttctttttcttttccttgagatagagtctcactctgtcacccaggctggagtgcaatggtatgatcttggctcactacaatctctacctcctgggttcaagcaattctcctaccttagtctcctgagtagctgggattacaggcacccaccaccatgcccagctaatttttgtacttttagtagacacggggtttcaccatgttggccagtccggtcttgaactcctgaccttaagtggtctgcctgcctcagcctcccaaagtgctgggattacaggcatgagccactgtgcctggccattattttttcttttataaattgtgctttggtattatatttaaatactttttgtctaaccaaaggtcattacaatttgcttccatgttctcttctataagttttatagttctacaatttaaataagtctattatcaactttgagttactttttttgtataaaatatgaagcatagtttaatattctttttaaaaatataaatgaaatattcacatgaatatgaaattttttcataattccagcaccatttgttgaaaatactattctctctacattgaattaattttgtacctttgtccaaaattaattggctattcttacgtggatctatttctgggttctcatttctgtttcattgatatgtatgtctggccttttaaaaatattatattatcttaattattgtagagtcatcataagtcttgaaatttggtgctatgagtcttccaacatttttcttctttttcaaaattgttttggttattctagatactgtgcttttccatatatatttagaatgagtttttcagtagctaccaaaaaagctttcttggattttgattgggattgcattgaacctatagatcaaattaaggagaactgacatcttaacaatattaagtattctaattttgaccatggcatatctttccatttagttagatcttgtttgatttatcagaatttttatagttgtcagcatgcagattctacacactaaacaaaaaaaaagatttatacctaagtatttcactttaggagccactgtaaatttattttaaaaaaattggtttccagtggttcgtttctagtgtatataaattaatatttgtatgttgaccttgtgtcctgtgacttggatcaacttgcttaccaaatctagaagctttcttttattccctagtttcttttttagatttttgtatgtagagaataatatctgtagagaataatatctataactagagacagttttatttcttcttttctagtctgtatgcttttttttttttttctgccatattgcacagactaggaacccagaacaatgctggataccaggagtgagagaacctccttgacttgttgaagatcttaggggaaaagatggaaagtctttcactaataggtataattataattaattatttcaatatcctttattggttaaaggcaggttcctaggtgatcacaagttttttttttcacgaatagatcttgacttttgtcaaatgctttttctgttatctattgaatatatacatttttttttcctttttagtctgttaatatgttaattacactggctgctttttgaatgttaaatcagtctggtagtttttggaataaactccacttggacatgatgtattatatttttaatatatcgtttgctgaaaaaaaatattggtagaatgcatttattgttggcagtaaagacctccatgttctttaaaagccaaagaccagggccagagtactgctggaagctaatctcctccctgggagccacacagataaggttaactggaagcaaagggctctggaagagaggaagccagggtgccgctgctgcgccccgttcctgcctggcttggacgtatctggaactgacctcattctttcactatggtggacagaattctaaagctgtctttctaagatgtcgtcccctggttatataatcaagcgctaatccaggtaatgctgtgaagggactttgcaacccaaattaaggaggctaatcacctgacctgaaaatatggcaattatcttgggttactgagtaggtccaatgtaatcacattagctcttaaaagcagaagaggaagccagagagatgcagcagaagggctggtgggactggaaacatgagaactttgtctgccattgctagttttgaagatgaagatggaggaagggaccaccgaggaatgtgggtgggctttagaagccgagaacgatgcccgcaaggaagcaagcaagggaatgcacccggaacgactttggaagcagatttattccccaaacctccaggaaggaacacagccccactaataccttgattttggcctatgagacccagagcagagaacaagctgaaccccactatgtgtggacttctaacctacaaaactgtgagataatagatagacactgttttaagatgctaaatttgtggcaatttgttaaggcagcaataaaaaacgaatgctttggcttagcaaacatatacggaagaccttctatgtgtcagggactgccaggtgctgaagataaggagactgggaagaaaaacgacctctttatctaaggggcgcaccaaccagagggagactataacaccaaacaaaacatggaggtattccgtatatgtgccgtaaaagcaaagcttatcttggttgcaaagaataaaaagcaattctggctaactttaaataacaaaagaaaaaaaaagagagactatgtgcttttaattttgagagcaaagatactggaagattctagtttgaatcttctagtttgaaggaaacttcaaacatgtcagatttggggaaaggacgaccagtacattcccaggaaccttagtcatagaagtttgtagactttctgctggttctttaactctgaacccacagttcttggccttaatttatcctttccaaatttaaaattataagagggaaaaagacaaggcttagattggtcctcttcaaggacggcatcaatctattcatgaaggatccaaccctccccagcccaaacacctcccattaggccccaccttaaagactagtaatcaaatttcgacatgaggtttagaggggataaatatccaaactatagcaagggtaacctgttttacttagagtccattaaaaaaacatcttcacagcaacatgcagcctggtgtttgatcaaatttctgggtaatgtggactaggcaagttgacccataaaattgaacatcacatcttgtggtacacataacccatggggtctagctctatgggtcagagcctcatccccagaaagaagcctctttatgggccttaaagttagtcaaacaggtgctcccaagactgtccagttgtcagccacacttcaattacccctacaatgaggatggtaatactcataggattttttttgtgtagcttggaaaaagattatgaggataaaatgattttgttaactgttaagtgatgtgcgtatgtgaagttggcattatgtattttaaattaagattcaaggaaagttggcaaactttgaaatctagaatttgtacttgctactaaaaacgagtaatttttaagtgagacgtcaggaaaccccaaagccttttcgtgattccaaatgctgtcagaaactcctcaaagcaaaactccaccatctgcactttaaattgaaaagtgtggcgagtcctcagggatctagaactagaaataccatttgacccagccatcccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatataccccatggaatactatgcagccataaaaaatgatgagttcatgtcctttgtagtgacatggatgaaattggaaatcatccttctcagtaaactatcgcaagaacaaaaaaccaaacaccacatattctcactcataggtgggaattgaacaatgagaacacatggacacaggaaggggaacatcacactctgggggctgttgtggggtcaggggagaggggagggatagcattaggagatacaccaaatgttaaatgatgagttaatgggtgcagcacaccagcatggcacatgtatacatatgtaactaacctgcacattgtgcacatgtaccctaaaacttaaagcataataaaataaaataaaataaaaagtcatgaagatattaaaaattttttttaataaaagcacgatccatataaggaaaaaaaaaaaaaaaagaaaagtgaaactgcgatcatccctgtctatcaggaacagccaggggctgatgaattgcaacaggatagggttgtcccaaccccaaatgacaaagactcactgccctgaaggataaaagtgggaaaaaacctaaacaaaaatcacgagttgagccagagatgtttgtgacccaacagaacatggatttttcacgttctcttgtgcttttctggtctttactggatgaaacatcagagcatctatgctgattgtattctgacaaaactatcagaggccagagtgagtcttacaaattttgtgtatcttattgcttcacagtcagtcccttctttatagcatggctgagtgctgaacttagccccaactttttaaaaattaaaattggtcaatattgcaaccctttcctagcccttctgtcttctgtccctccctcccttctatccttcttgcagatgtaattcaggcagaattctgacattcatgtatcaaacttgctgttgccggcatcattttgcttagtgttcattatcatttctgaacggttctatcaggcaaaggcgtcctcgttctccaagcaaggaagccccagccagacagttgtcaaggcaacggaaaatgcacactgtgaactaccaagaaaaggccgtttctggctgctaagagtttttgcactcttgaggctcaaacttaatttctgggcttggcaaaaagaagtattttatggctaattataaaatgtacccaatgttattagactaggggatagatgattgcctgctaaatgtgttgtgaaaaattaaagcagttttcagagcggagggagctaaactcagtgtgcccaaaggatcgatcgcttatttttgtcattctttatagctggaatacaacagttgatttgagtctcattatctattttgttgtcttaggtgttcaaaacaaggtagaaagtgcaccgtccatatttagactttttttggttggcgggggtgatggttagggcagcgtttaaataacatgtttcttggtccacattaagagccgtacattacacttagcaggtgagactataagatcagagtctgtgggctaatttcgtacattagctgctatcattgtcttccacatctatttatttatttatttttgtcttctattctcttcccatgtacttgcttgtcaacaaaccccaaataaatgccacatattaagttaataaaagacatggtagttagggattgaaagtgtcagggtgaaaacactggtatgacaatccgccttcttaataaggttgttcttttgtaaacaatgttttaaaatctaactttatatgaatggttgattcaaagcctggtggccagtgttacagtgaatctccattcaccgtaatggagattcactgtaatggactcagttaatccagtcgttgaataatccatgttaagccttcactttttttctttttgggtgagcctccactcattgaaaacaaggtaaacttagactgaggttgacatgattgggtatctttcctcaggatctcccccttaagaaaggaaaactgaaccatcctttagaagaggaaatatgatttacctgaggaagaggtaatatatttctttctacactcagctgattgatcatggaataaaacagtatttgtagtcctctctcaggtagagaaggctcatgaagttgatctcctaaaagaaaacaatgctatggaaactaagtatgttttaatgtttaatgtgcatcgtatttactcataggtattcaaacaacatccctccctttagcctgaaatgttcccaggattgtattttatacactaggcacattgatataggcaaaggaatggggaaggtaattatccagcaatcagacatgtcaaccaggcttgtttggataactgacagcggtgaatcaggttcatcgcctctattgctttgtgggactttgtttctctttatagcatttccacatgtgttgaaacagggcctaaatgtaggtgttcaggatattaaaactagagctttctaaaaggactgagtataattaactcttgacttaagttccttctttaaatttcatttctatctgtggtttagaggcagtgggaggctgtgaaatggaaaaatggaccaaaataagaaactgaagtgaaatgaaatgactgaaatctgtttccccatagccagctttctggagcgtttcagcagcgccagtcatccttgcatacactgagtttctactacattccaggtgttgtaaaattttctttgagtggggtagaaagtaggagaataaaaatcaaagtgacgcctggtccagctctcaaaaacctcagattctaatcaaatgcagattcggtctgaatgtgcatcatcagaatgtaccaagggcccctatcaacgtgtatacagtttccacaggaacacagaggagagagcagctatctctgcctggaggagttgggaaggttccactgaagaggtggatcttgaagaatgggtatgagttcaacatatagagaaatgggatatgagactgaaagagcattcccaacaatgcacatgtggctgagaggaagagctcgatgcatacgagcagtagagagttttttcacaaggcaggggactcaggccacttgtatggatggaaaggaagggacttaagaaaggtttttaaggcaggaagagctggctgtctccccgagacgcttctgataagctgtgctaaagagcttggcatttagctcctgggttacagggcctctgaaaggttttaagcaaatgactaccctgaagagactctggtgggtggaaagacaaagcatggattggagtgagaattaaaggtggagacaggctcagggattaagggatggttcaagggagatacacggacctgaacaaaggtagggggcatggggatggagatgaaaggaaaccatcagaaaagaaggggccaaagagggaggttatcttggcagaagaaagacattattcatcttggttggttggaaatgtgggtctggagctcataagacagatcatggatagggatatagctcagggtctggggtcctgactccccctaagggtcttacctcagagagtgatgactgagcttctggaggtcttgaatttcctgaaatttatgtaaaatggaaggtgcatgtgtatacatttcctagggaataagtcaatagccttcatcagtttctcaaatggttggaaaatggaatatagaacagcaccaaaaaacactatcttaaatgaggatctatctacagggtgttaaacggaagtgagagtaacccagtgagcaatggagaggagagaaggtcccggcagccttgaggccccttcccccttaagctgagcactcagtgtcactcttctcagctccatctgactgtccccatctctaatctctccccatatgtacttcatatgaatcaaaggaaataacatagagagcttgtaaactctgaaatgctctgcaagtgtttagttatcatttaaaagatgaaatgaaatatggcaactccatttaagcttttattagttctgcccatctccatggaaaatatctgtgacattcaaaatgcctgttgatgctacattcactaatctttttattaataagtgagcatgtaaagttcacacacctcagacactaagatatgctatcagtacacatcgatgccttcctcctaattcagggctgggtaggatgggcctgagacaacacagatggatggccaatgactcagaggtggaaagtggaatgcaacccagcagtactgtgcagcgatgcagtcagatagaaacaacatctaacttttcagtgcagcttaaatgatgttgaattagccatggtgtggcggcacgattatgtctcaacatcactgtgctaaatctaaaccagaaggaagccctgtgtgcagagagcgatggtagcaaaaagctctattaagatttgtttcagaacagaaaagagtcaatatatactataaattaaaaaaaaaattgtcaccattgtagccgatgtgagaaattttggcatgctatttatagcccagattcccatttgaagtaaaatgcagtcagattgcaagaacagggttttgagccatagaattgatcatagagctgatggagccacatatcaagaattgttgatgggagtgggttctctgcatttagacttctgagatgagggataaggaagaaccctctaatccaggtgtctaaaatagccatgggtcatttaagaaaattatccaccaaagattccttaacaaatttttttctaaaggcgggtttaggcacatggtaggaaggaaaatcaaaaagaatccctttcttaaatgagttattaaagaaatagatttgattagaaatgaactcatgaaattaaaatgttaggatgattgaaagtagaacatcacttttttcttgtgaaggtcaaatgaggggtgtgcttgtgagaaaggaaaaagacaacagcaaggaaagcaaattaaaaccaacatcaggttgtgcaatggactaaatgtgttcccttaaaattcatatattggaatcttaacaccaatgtgatgggaataggaggtggggcctttaggaagagattaggtcatgagagggggccctcataaattagattagtgcctttttaaaagggacccccgagagctctctctcaccctgtctccccactgtgaggacacaaatagaaggcagctgtctgcaaacttggaagggagtcctcaccagaacccaaccctgctggctccctgatcttggacacatgcctgttgtttataagccaccatctctatgacactttgctatggcagcctgacctgactaaggcaagctgggagttagaactctcaaattctccgaatctcagccctgacattcaatagctgtgggtggcatgatgggcatggcactttacagatttgtttcctgacttttaatctaaacaagaaagagcacaaccactactgcctacctgagatcattgcacacaagtgttttataaactgttatataaataatttattttggcacaatcttgaaattttaaatgtctatatgaaaattttctctgcttgtcaccactacctcctgtccttatagaaacgtattttcatgagccatttggttcagagtttaaaagcagggagaataattattcaaccataattgatgtcaagcaatgttgtaaaatctcttaacttatcagagtctaagcactgttggttatgaaacccaaataataacaatgcatgtgaaagtgttttgtaaactttaatgctcaatgcaaatgtcatttatttatttcagtttctctcttactaaagtctgtttttctgatctttttgctgctggtatatttttgccctagtaagttcaaaaaaattaaaaagtcgtaattcttggcttcagatacctccctaggaattctgagagttttttttctatatagatctgcattgcctgcttgattccagcacatctcaactgggtagctcctacgccaaccatttatttcatgagcttgcatctcactctcttctcaccttctccattaacctttaccttggaaacgtcagatctgctcccatctaagccaaaaacactatccaattttatatccattaggtaatgccttgtgattcaaactacatctcaagattctccttgttgagaaagcttatctcaatgtgcttggaggggtgacaaggatgcaattcgttaatcattgtaactcttcatatttagagaatgcagcaattaaaaggtgcttcctcataaacatgtgaccttgtttgatcttcacttctataaagaaaaacatagtacctataattatttaacattattccatccattgtgcaaagtgagaaaaccaacaatgtttaaatccaataaagtccaaaatctctcagatgataagtaaaacagtgaagtttgcattttttctgtctacatctaagttttttttctttcaggattttttctttgtttttggttttctgaagtttgaatatgatatgcctacatgtgtattttgtttgtttgtcacttatcctgtttggtgtactctgtggcttggtgttttgcattacttttggaaagttctcagtcattgtttctttacatatttcttctgctccatcctatgtttcttctcctactagtattctaattacatatatattgcatcttttgaaattgtcccacagttcttaattgttctgttctgcttttatcattcttttttctctttgaatttcagtttggaaagttttcattgatctatcttcaagctcactgattctttctttggctgtgtctaatccactaatgagcctatcagaggcattcttcatttctgttagtgtttttcatttctagcatttccttttgatacttttctagagtttccatctctctacttcattatccacctgttctttcatgtctattttttccattaattaccttaatatattaatcagttactttaaattccataataattacaacatatgtttcatatctgagtctagttcttaatattgttttgtctcttcagaatgtttttttcttgtcatttgacatgtcttataattttttgttgaaagtcagatacaatgtatcgagtactaggaagtgaagtaaataggcatttagtataagaattaatggtcgtctggcagagaagttcgtttgtctttagtgtttgctatagttgtatgttacaaatataaatatagccagaggtttcagatttctctagtgtctttttctttgtctcatctcttacctttgggcttccctaagtactccttcttagagagagtttgtgtcacctctttcagctgtgctgtattcccgctgatgtgatggtaaggtgcaggggaggagaagcattctctaattttattaataaatctcagtcttttaatggggctgtgtcttggggctataaccgttacaagctttctcctttggtaccgtcccttccccctgcctcctactccctttcctgtctgcagcctccccaacccatttcctggaagccatggtccttgttgactatggggatcttttgccccctataaagtagacagaaagtttggggggtgctttccactggaatatgactctggcaaagtattttctcttggagcataggcctttgttgcagacacatttcacaaagattactctcccccttctcttgccaaaaccttgaagagatcttgcagatcttcatcttgagaacctgtgaatttcctaaaggtaaagccaatgatggtatggggtccctgaggactggggacccctggaagtttctgactctcatgctagtctacactcctggtttatcaaaatttccatttgagtgttcctatgagtttatgcctcatgtggcttctgctccaggtgagcagatcttggctatatttccccagatttgggggtggcagtttgccctaaagccacaattctctcgtggttccaagaaatataattgattttccaagaaaaagtccagcttttttgttgtaagaataaaattatgatttccaaagtatttacatgtcagaacaggagccagatgtcccaagtcatttcctttacctgagagccttcaccagcttctaagcaagaaaaagaaaaatctataaataagccaccatctacttgttgctattagtaaaaccatttttgtgttattagtaaagaggaaggaaatgctgatgtattgacttctctatctgcccattctctatggaggaggaaagccagcagaaaagtgctgaaatatctttgaggcataaaaagctaagacataccatgatgcaggagtctagcaatctgtccagcagaaggctcagtctgactgtggccatcaggggtgtcttaggagggatccaggcctccacagattagaacaacctccagatatttcccacttctggctagttattgatatgctgtccacaaaatcatggcaactcataaaatcacaaaaatttgcatgttggaactggaagattctcagggcttttttctttttctttctttcttttttttttttttttaacaaatgaggaaactaagtcccagagagtctggttcaaagccatacagttagctcttgacagattgtggggtgggtggcgggggagtgggggcagtctacacttttatcaatgccttttgctttcactctaaattacttttattttcattttattctaccctttggagcataagatttctatgtacttgtatatatacttttctcattagtatgttggctccctaaggagggtataaactggccctttatgttattactaaattcccctaggcatttataacgatgaaaaatgtcaaaaaaaaagaaaaagaaaaagaaaaatatagcagtgctgaagatggggaaaaaaaggtaggctacacttatttatttcccttccaccttgtcatctaggcattttgcaagcatatcacaacagtatacatctgatatatctgctgtcacctccatcacccttccattccacctgagatcgtgttaggaaaagaaatgaggaagacgtttgtgttcttcttgctcattgtttcaaatgatgagaaagactttgatgagacagacagaaagaagaatgaggcaaagcaagaataataaacccaagtgcaatgataaaaccaagtgtgcagtgggaaaatatgcaagactaaatctaaatccttcaatgtgagtcatctgaggatacctttgaaaatggtatttttatttggtttgtctgaaacattatgtagcttttgtcctgtgcttggttatctcagagtcttagctgtcagagaaggaagggacctgagagcctgctttgtttaaagttcctcgtgctgcactggaatccattcaatcaccagggaccagctgacttctgctgaacccaaccccatccacacccacccccagtcctcaacccacttactttacattccaggggtttgggtgttagaaagtcctttctcttgtagaactgaatatgatttccttgtaaatccatgaattggtcttaattacatcataaaataaatatgcttgacaattcagctattaagcaaagtatacattttgtattacttagatgaagtctttctgaggagaaatcttggacaaaacttgacagtctattcttttattttcatggatctccaaacaatatgaaccaaaatggctagcctgagtgatttaaggggttcagcaaattgacctataaaaaaaacggaggccaaagtagtttgaaatataggacatagaaatgtctttacttctccccaagtagtgaatgatcacaggtccctgtggggtactcagggcaggaatatgcccccaatttgtggagatgaaggatcactttctcatctagagtggtaaattatattaattggagaaagtggtgaattatattaaaagaggcatttccagttccaactcttcagatacacatggaaatgggcagttgtgagtatatttagagacaccatgttgcactagacgttagagaacgcgagtgtcacgttaaatggtgataggtgagactgaaattagttatctgaacattctctttttcagaaagatactggaccttgcattagaaaaacctggaaaaagttacaaggtatggagacattattgatgtcaaacatgatttcagacaggctgtttgttctaacctcagccaaactccggccccaccggggaggcagcaagcagatagcaggaggaatgtggaagagagaaaggcttacggaaaatggaccaaagaggaaacaaggcagaagttctccatctcttttgattggggccaactatgagaagagatagccccagtgagaaaaagtgagctctaagctccagggatcagcagggagccatgaggggaaagttttagtacctgagctctgtgtatatacaagaaaatgcaaatacaaattgagcaccaagaaattacacatctatacgcagaagggataagaaaaaaaggcaaatttacaatgtgacatcactaattaaaagaattagggaggggcaagagggatcctactgtagtagatcccagactttttgagtttattaatttttaaaactagaatgttgagttcatttgtttaaaatattaaatgtaattcaaataatggtatcttagtgattattcaaaatcaaaattttatttgtcaaaaagaatgctgaaaaaggtcatattcaaaggaaataatgattatatgactaaagatagtaattaatttctcaggaaaaaaatgatccacccacacataaaatccttcatctttgtagaaacttatttgaggtaaccctattttgctcccttaagctcacctttgattgaacaaagtaaaaatagtctttctttgtctatgcatttactttaataaataggcatctagaaacatcagaggcaataatatatcaaaagctaactgaattccaccaagctgttttgaaaatgggatttctccatcttcgaattttcaaaagcaatttatctcctccacaggctgacaaaaaaggaaagtttttgatgccttactctgagggaaaatttcttgatttcaaatatgtaaggaaaagagttctctgcatattttatcttattgtatatatatatacatctatcactttgtttctttgtcaacctcatagccagaattactgactgatgatcatttgatgtaccacactaatttcagtgagagttgtactgagtgttttatctcataaatatgtttataatctctaataaactaggtatgcaatttcttagtgaattttcaatggtaatgcaaagctaaatatcaattaattaaagagttctgggggtggaaaaggggacaagggaaaggaaccactcttggttcttacaagatggaatttgcaagagaacttaaattacaaaggaaaaatggcattaaattaatatctaatttctaagctagttgaccaaattatttgaggcttattggcgttctcttgcttagtattgatatagtacttacttaacttgctatcaccataaacaaaaacaaacaatgatgacatgctcttcaaactgaaaagctgcaggtagcattccccaccttcaatagtagctgcctgaatctgtgtctctccatataacctttgaaatcaaaccgttcaatgaggatattaagaaatatcacccctaaccctcatgtacaacaaaactggaagacaaagaatagtttagactctaagtgtaatgggaagaacctctcaaaccagcagaatcagtttcagactcctgactaaagtctctctgatggacaaggatggaagaggtgtgactgcatttgaggatgtagcagggaggaaaagaaaaagcacccccccaagaagaataggggtggatctcaggagtgtactgagatgggacatagagaacagggacatgaggcctcagggatccactggctactgtggaattgaaagaaagaggcttgatgtttcaaaggaccataggtgtaagtcttctagtaaagaagcaggcaatgtggaggcttgctggtaaaggggaaaagatagcaaaagctagaagttataggaagaagtgttatacatcaggaagcactgtggccacctccacacggtagaagaaagcaacgaaaaaatataccccacttacaagggcaacaaaaaaatataaaatacttaaaataaatgttgtggccaggtgcggtggctcatgcctgtaatcctagcactttgggaggccaaggtgggcggatcacgaagtcaggagattgagaccagcctagccaatatggtgacatcctgtctctactaataataaaaatattagtcaggcatggtggtgcaagcttgtaatcccagctaatcgggaggctgaggcagaagaatcgcttgaccccaagaggtgaagttccggtgagccgagatcgcgccagtgtgctcagtctgggcgacagagcaagactctgtctttaaaaaaaaaaaaagttgcaagaaatgtggaaaaaaaactcatgaataagccttgaaaactctcctggaagacccatgatcaacttgaaccataaggaaaatgccccttgttcatggacagaacaagtcaacattataaacttgccaattttcccaaaaagaatgaataaacaatacaatcacaatgaaaatagcaagaagtttgttttttccccctcgagctagacattcgattctaaaattcacatgaaatataaagatgggataatagctaagaaactcctgaaaaggaagataaactgggtggggggcagccctaaccctatcaggtattaaaatatagcattgagctgctgcatttaaacgattctggaaatgttccatgaatagacagaccaatgaaacagaatagaaagtagatccaagtatataaaaaatttgtgtttgataaaggatgaatgcatcctttgttatacacagactttcatttgggaatgtataaatttgggggaataatgagctttcattaattactgtagaaattatgaactttcattatttattggggaaattatgaactttcttgtaaataatgttgaaacaattggtttcatttgtaagagaaaaacgtggacccatacttcacattatacttaagaggaaattctaaaagatctaatatataaatgtaaaattgaaaccacatagtactcagatgaaacaaaactttgaagggaagaaaatactcaaaatccagagacaataaaaataaaagaaagaattaataaattatattctctgtgtgtgtgtgtctgtatgttttaatataacaaatagaacaggaaaaataatcaaagctaaaataaaagaacatgttttcacctgaagaatttaaatctgtgaatcaaaatacttcatctattatcagttgactaaaaccatagacctggacacagttttgtaaaatttataaaagctcactccccaagtatttcagcagaaaagtcaatctacctacaatttaataaaaataatatttgtctcagacttttccatagcaatgaacatcagatataaataaaagtaacatttacagagatttaaaaaagaaagattgtaacccaagaatataaactaaacaaattttcactcatctgtaaaggtcaaagtaaatagtcaagtctttaggaagtagttcacttccatgccattttggagaaaaataaaaaaataataattgaatatgtagtacatcagagcaaagtaaaaaacttggtaatatgaaaattgtggtaaataaagaacattcaggttcatttttaaaagttgcaattattgaaaatactcttgaaaccatagggtaaatattttgaaaatgctcctgaaaaagaagagtctccagtctttccctctgtctctcacaacacacagccacaaacacacttacgcacttttaaaatattagattattacaaccaaagttaaaaattagctggagaagaaggccaaggaataaaaagcagccagtttcctaattttctataaagaagcatcaatagaaactgttttatgttggcaatactaattagataaatattggttcaagtgcatgttctcagatttgaagaaacttatcagataattaaaaacaaaatatacctctttctagttattagaagtacaaagacattaaaaataatcaacttacaaaaagcggaaacaagaaaataaaagcacacaagcaggaaaataaaggtatgaaatgctaactccctaaagtctattattttctcatctataaaatgtgggttataacaaacctaaccataggttaattttgaagattaataagataatgttcaaaaagtatttctcagtgtctggctcacaatcgaagctcaaataatgtttattattactatttataataaaatatgacagttatcaattatgaaagtaaattttcatagttaaaatttaaataaaatattaaacctttcttattaaagggaaaaattaatacaataaataaaataacaaagagaattaaaaatttaggcttgtgaaaaggtatctcaaacaacacaaatcaaaagaaagtaacagtgtagaattccaagtaaaaaagcattagatgatgcaaagatggtcattttatatggatacatttttaaaaatcacagtgatgataaaattgtcataaaatttaattaattaaacatttatctttacaataaataaaagtatttggaaatacaagggataagaaataatttttaatgctttgctctcagtatttataaatcaagaagaccaaaaatagggcaaccctcttttgggccccctgtccgtggtggagagctttcttcaattgttcattaaactcttgctccaacctcaaaaaaaaaaaaaaaaaaaaagaagaagaagaagaaataatataaatcaagatgaccaaaaatatacctaagatggtagaggactttaataatgtaattaattagatttaattagtgtatattaaacaatatacctttccaaggttttggaaaaccttaacaaaaactatatcttatgtagtctacaggatttaaaaaaattttatttgtatatgacacactctatcatgactatgtaataaaaataaaaactaatgggaataaaacatttcaaaaaatccagtaattttagaataaaaagaaaacattgtaaatattagctaaaaagaaaaagaaaatgaaagttactactacaaaccatttagaaagtaatgaccatgtaaaactatatgttaaaatttctgtaccaagacaattaaatgggaaaagaaaaggcctttcagcaagtggagctggaagaactagatagccacacaagagagaatgagttgaagtcctatctcacatacaaaaattagcaaaatggaggagctaaaactctaaaactgttagaagaaaataagcataaatcctcatgatcttagaatagacaatggtttcctagataagacatcgaaagtataagctgcaaaagaaaaaaatacaaaaattggacatcatcaaaattaaaaacttatgtgtttcaaagaatgccatcaagaaagtgaaaggaaaatccacataatgggagaaaatttttacaaatcatgtatcttataaagcaggggtccccaagccccagaccacagactgtaccagtccctggcctgttaggaaccaggctgcacagcaggagatgagttgagggaagtgagcattactgcctgggctctgcctcctgtcagatcagcagcggcattagattctcatggaagtgcaaaccctattgcgaactgtgcctgcaaggtgtattagtccattctcatgctgctatgaaaaaatacctgagactgggtaatttataaagtaaagaggtttaattgactcacagttcggcatggctggggaggtctcaggaaacttacaatcaatggctggggaggtctcaggaaacttacaatcatggtggaaggcaaaggagaagcaggcaccttcttcacagggcagcaggatggagtgagtgcaagcaggggaaatgccagacacttataaaaccatcagatctcatgagaactcacttactatcacaagaacagcttgggggaaaccacccccatgatccaattacctccaccgggtcttacccttgacacatggggattacagagattatgtgaattataattccagatgagattttgggtgggggcacagccaaaccatatcatgaggaatcaaggttgcacactctttatgagaccccaatgtttgatgatctgaggtgcaacggtttcatccctaaaccgtgcccctccccctgcgcttcccaccccctgttccaattttgtgaaaaatatctttcatgaaactggtctctggtgtcaaaaatgttggcgaccactgttacaagggactcgtacctagaatatgtaaagaattattacaactcaataatagaagggtaaataactcacttttaaaaattagcaaaggatttgaatagacagttcttttaaggagatatacaaatggccaataagcacatcaaggattgcttgacatcatcagccatctgcaaaatcgaaatcaaatccacaatgagataccacttcacacctgtgacgatgcctataacaaaaaagatggataaaaacaggtgttggcaagaatacggatggagaaactggaatcctcatacactgctgctatgaatgtaaaatggtgcagccactttggaaaacagggtggcaattccactcccaggtatataccaagagaaatgaaaacatacatccacacgaaaccttgtatacaaatggccatagtagcattgttcataatagccaaaaagtggaaactacccaaatattcatgaactgatgaatggatttaaaaatgtggtatattcttataatgaaacatgcttccgtgataaaaaaaaaaaaaaaagaaatgaagtgctgacatgtgctacagctgagacaaatcttgaagacatgaagctaagtgaaagaagccagtcacaaagaaccccatatggtatgattctgtttatattaaatttccaaaataaaggaatttatataaaatgaagtagattaatgcttgccttgggctacaggggctggagcaattgagggtgatttttaaggggtgcaaggtttatttgtattgtcatgaaaatgttctaaaattgattgttgtaattgcagaactctgtgaatatactaaaagtcattgaatcatatactttaaatgggtggattgtgtcacatatgaattatttctcaatagagctgtttaaaaaaaaaaaaacaacttgttggccgggcgcagtggctcacacctgtaatcctagcactttgggaggccaaggcgggcggatcacgaggtcagaagatcgagaccatcttggctaacacggtgaaacaccatctctactaaaaatacaaaaaaaaaaataaaaaatagccaggcgttgtggcaggcgcctgtagtcccagctactcaggaggctaaggcaggagaatgacatgaacccaggaggcggagcttgcagtgagccaagattgcgccactgcagtccagcctgggctacagagtgagactccctctcaaaaaaaaaaaaaaaaaaaaaaaaaaaaaaaacaacttgtactatgacttcaacttccaagtggaatgtagatgttgtgattgcccaatgttcccaacacaattactggacaaaaagccagacaaatgaccaaaatcttgtttcaagtcgccatacagttgtagaaacaataattagatgaactggaatttcacaggaggagacttctagaacagtaggaattttgctaatgtttagtaaggcctcatgatcagatttggcccacaccagggagagaaaccggagatgtttttgttggtcactcagggctggtatgggcgcaaaagattatataacttgagaagcacagacttaataggtgttttccccaagaaattctctgtgtgctggagatgaacatggaggactcgagagctaggctaagggttcctaaaagacagagtaaaatctgctttattctccaagtgcttgagagactgtatttccccagagggactgggcctaccaactagtcctccaagatgtttgccacatttaaagctgcaggatatgggagctaaagatccaagctcaaatctagaacagtaggaattttgctaatgtttagtaaggcctcatgatcagatttggcccacaccagggagagaaaccggagatgtttttgttggtcactcagggctggtatgggcgcaaaagattatataacttgagaagcacagacttaataggtgttttccccaagaaattctctgtgtgctggagatgaacatggaggactcgagagctaggctaagggttcctaaaagacagagtaaaatctgctttattctccaagtgcttgagagactgtatttccccagagggactgggcctaccaactagtcctccaagatgtttgccacatttaaagctgcaggatatgggagctaaagatccaagctcaaatctagatagtggatttgccacagtcttccatgtttgagggagagtgacccactagtctctcagcccaaatccttgaagggtcttccttgagaaacagggaaggaccaaagatggatgagtcttaggaaaactgcatatgtgtaatagaactaagaggggaagcgggagagagacaatgggccaaaagcaacaactgaagatataatggcaaagcatttgccaaaatggataaaatattaatacatcaattcaaaaattcaagaaaccctaagtagctcagcaaaccccaagtagggtttaagaaaaaagaaaatcatactaaggtacattacagttaaactgctaaaacttagcagatgagctcaagtttcttttctgaagcaaattcatatccttaaatagccttattaaataataaatatttaaaaattttaaaactacttattcatcataagaaattaagaaaataataaaatctaagattcacaggagattgggttaccaaaaataaatgctgaaattaaattatcaaaaaaagggaaaacagttaaattgataaattaataaatcttaaaggtggttattttaataataaaaacccaacaaaagacgtgtatttactttcaatgtttattattttaattaaataaatttgattcaaattaaaaagcacaaatgtgagagtgaaaaaatgacatgactacagattcaaaggaaactacaaaaataagagaaactgcaaaaatatgccttccataaataaatttgatagttttaatgaaaagtataatttctggccaaatataaattataatattttacttaagaagtagaatatctgaataggcctattactatgcatattactaaaaggattattcagaaattttaaaatttactacaagattttacaagattaggttgtatcacataaaattactttatgctatatataatagagtacatatgcataataattggctatatttgaatctcaatttatttttgacattaaattaacttgttaccaagcttgagaaagcactacaaccatgcaactaaaaaaatagcacatgcgacactctcacttatgaatataggtgcaaaaattctaaaggaaattctaacaaatcaatttcaatgctaaataaaaataaggccataccattttaagtagaattattctaggtatgcagacttacttcacactaggcaatctatcagttgaattgatatagctacagttcaaagggaaaactacacaattatttctacccatgctgaaaacacattaataattaagatacatttaaaaattaataagctttatgttttagagtagttttagctttacagatatattgagtagaaaatacaaagttcccatatactccctctccctaccacagtttcctctattatcaatatcttgcattgatgtggcacatttattataattgatgagccaatattgatacactattattaactaaaatcaataggttactttaggtttcactcttggtattgtacattctagggattttgacaagtgtatagtgatgagtacccaccactaaagtatcttatgtaataatagtttcactgccttaaaaatcccccttgtactacctattcatctctccctgtcctccagtccccagcaaccactcatctttttactgtctccaaagttttgccttttccaaaacgtcatagagtaggaatcatacaatatgtagccttttcagattggcttctttcacttaacaacatgtgtttaaggctcctccatgtctttttgtggcttgacaactcatttcttttcattactaaatagtattccattgtatggatgtggatgtaccatagtttatttgtccagtcacctattaaaacacatctgggttgcttctaaatgtcggtagttaagaggaaagctgctgtaaacattcatgtccaggtttttttttctgtatgtaagtttctaattcatatgggtaaatatgagggagtgttactactgagtaggagtatgcctaattttgtaagaaactgccaaaatcactttccaagtggccataccattttgcattcccactagcaatgagtaagaggatctgctgcacaacattctcatcagcatttggtggtgtttatgtttgggattttggtcattctaatgggtgtgtagtaatatctcgttttaatttgaaagtctctaatgatgttgagcatctttccacaagcttattttccatctgtatatcttctttggtaaggtatctgttgagatcttttgcctattttttaattggactgtttgtttcttactattgagttttaagagttctttgtatatcttaaatactagcctgcatctgacatgtgtttcacaaaatcctcccagtctatggcttattttttcattctctgaacagtgtcatttacagaacagaagtttgaaattttaacaaagtccaacttatcaatttttttatggattgtgcttttggatttaagaagtcattgccaaattcaaggtcattgaaatattctcctattttaccttctcagcattttacaagatatatttttaattaaaaacaaatagatgctctgaatcagtcatggtccccacaaggatttttaatagaaactgtaaggaaaagacaacttacaatgggcttggtaaggttaaggaaatatataagggataatgcttgcaaccatgataagctgtcatcacccaggtcaaaaggaaaaaagggaggagctagtgctgggacccagtgtggaggctatggtgaagaagctattattgtgaactccactactactataggtttcatacctaggcaagaagagcatgtagtcctcataagttgatagatataagaaagggggctgggcgcggtggctcacgcctgtaatcccagcactatgggaggctgaggctagcggatcatgaggtcaggagatcgagaccatcctggctaacacggtgaaaccccgtctctactaaaaatacaaaaaaaaaaaaaatagccaggcgtggtggcaggcacctgtagtcccagctactcgggaggctgaggcaggagaatggcgtgaacccgggaggcggagcttgcagtgggtcgagatcgcgccactgccctccagcctgggcagtgagagcaagactccgtctcaaaacgaaaaaaaaaaaaaggagccctaactggcaggaacaggagcaaggatgggggagagccatcattctaagaaatggctgacaagccatcgttctgagaactggttaaccaacaacaacccacttgcacaacaccctgttcccaaataccttgttttgcacatagacccagcagcatgaccttatcagcacgtaccctctccagcacaagcctataaaacttccctccagcccctgactcttcgagacaacctcctctctgctgtgcacctcattgttctcttgcagtgtatcttcgtactttctacaataaatctgcctttctttatccatgactgtcttggtaaattctttcactgcctgcaatgctggacccagccagtcacaccagcagcattttggtggtccatatggagacctctcccctgttcactgttttttctcttctccaactccaacctcttagtggacagcatccaagcctggagacatctgatggccccccactgcagctactccctggtggatcagaaggtcccagtggaaagaagtttgaccgtcactgcccgatcgagtgagagtttagagtttactttcctttcccgtcttctggtggacaaactctagtatccctctagcagctgatggccactggccagggccattccctggtgtggcctaaaggccaaggagtgaaccaggtttggctgccttgcttggaagggaggatggctctctcctaacccttctggtcaaaagtccccagtccctacatgcagcacaataggcagcggcagcttgaccagggcaaacgcacacacattttggggaactcagaccccgtccttctcactctaaatttctcctgtgaagaaagccagccatccttttctggacattttaagcaacatgatcccaaatagcaccagaacagtgagccttccctcaacctttgccccttatacctggattcagcacccagtataattcatacgtggactgacctggggctgctcaccctgtgttcatccatccagtgtaaggctctcatgctgggaggtcctttctaataggtgggatgcccctttggaaagtgcctctcaaggctcctcagtggacataagtggaaccccctttccttggctggaggccccaagagaaattgtggtttgtgtccccagtagacattattttccaatccccccatgggacaaagcccttccattctctcagactcaccgatgggctgcattctaaaacattgggataaacttgactcccagactctcaaaaggaaacatcgaattttcttgtgtaatacagcatggccactttataaacttccagatcaggaatcctactggcttccaaatgggacctctgcccccagtagtattttataggttgacctctttggtcataattcttctaaacggcttgagattccttatatctgaggttgtgtaactctttctaagtttgctctcctctcccttacatggttccttcctttactaggacagctgcatttatacttctacttctcctcttcagtcctttgtctctttaatttactggttaaatttgtttcttccagaatgtagcaattccacagcaaactcctaatgatgcaaggatatcagccaatcaccctcagaaaaccccatgaatctcctctagactcactagatatcaattccatattaacacgctctttcttcctgagttctatcctccagcagcatttaatagactaagtcccataactcaggacaataacccacagggtcccctaacagaccaataatcacaggtagggcccacactgtgcccacagtcagcaggaagcagttggaagataagacctccataccaatgccaaagatttgtcattgttgttctgtcagcggggaacatggagtcctggtaagttaatagatacaagaaaagggctctagctggcaggaacaggaatgaggattggggagagccactgttctaagagatggctgacaagccatttttctgagaaacacctaaccacaaacaacctacttgcacaacatcctgttcccaaataccttgttccacaggtagccccagcagcatgaccctatctgtacatagcctctccagcataaccttatcaaacttctctgctgtgctgcctgttgctctcttgtatctttgtactttctctaacaaatctgactttcttaacccacaactgtcttggtaaattcctttactgcctgtaacaccagccccagcctatcacacctgtgacagatggagaggatgaagtacctttacttctctctcctcaccctcaatagcatgccagtgatccttgctggccaaacacaatcagagggcagccagcaagggagcctgggggctgctgtctgcatgggtgatcatcctggggcacaggcagagccaacatgagtaggctatccctgtgagagagggcacatggagcatgaggaccacagctctttgtgtaaccaaaaattagtgttccacactctagactcttgcagaccaagggttgaagctgagctctagcactcattggaaagttgatgtctttaagcctctgcattttatgtgtaattaggattaataacagtgctacattatagatattaagatgactatttatattaaatgtttgtgaagtattaatgagtgcttagtaaatgctagctgctatcactactgctgccactactatcaaaactactaccattactactactaataacataactactattgtcactactattaccactaccattagtactaccaccactatcatcactaccatcactactaatactatcattaccactactattaccattaccacgactatcattactactactaccacctccaccattactactactaatgctatcattactactactgcttctataattactactcctactcctaccattactactactagtagtatcaccattactactactactatcattactattaccaccaccattactactatcattactactactaccaccaccattactactactgctgtcattactactactgctactatttactcctaccgttactactactaccaccaccaccattactactactatcattgctactattactactgccatcattactattactactattagtttagtcattattatcagaggcgaggagaagcaggcagcataaccaagaacataagtattatttctcaatatgagacagaatctctatattaaattaatagccaaagccatacccaggaatgaaatatttacatgttctcactgaaaccaagaaccaaataaccagaggattgctaccatcattatcattgaatgttctagaaattttagccaacatattaagatatgcaacattaggaaagagaaaaagtttaccttttttggttaacatttacaaaatatgatggttctctgccaagaaaatcactccccaatttaaaaattaagtggctaaacacaaaatgaatgtataaaatttaacggttgttctgaaaactaggataaaactattcataatatttaatgaagataattttccacttacaatagcaacacaaactattaagtgcctacatagctttatatataattttgcaaacaatataaaggctagtaaaaaataaaaacaaaaaacttataactacattaagaaaactgggcacagtggctcatgctggtaatctcagaactttgggaggctgaggcaggaggatcgtttgaggccaggagttggagactagcctgggcatcattgcaagatcacatttttacaaaaaaaaaaaaaaaataggcacgcatagaggcatgtgcctgtagtctgtttacttgggaggctacaggtagctagactacagtaatggtagtagtagtcatggtagtagtagcaaaaatgacattggaaaaatgtcgattttttccaaattcatttataggattaacacaattgcacttaaacttccactgagatttattattaaatgtgttcaagtaaaactaagattcatctagaagaatgaatttataagtagagctcagaaaaaattttttaaatgcaaaacagaaaagattaaccagtgagatttgccctgttatatatagaaacataacactaatatagacaaaatatgtggttttggcacaagaatagattattggaacaatgaaatgaaacagaaactctgggaaaagaatacctacattaatataatgaagtaaacccagacatgtattctgacacattacccccaaagaaataccaggtggattaaatatttaaatgtcaaaaataagccaccataaaaatcttagaagaatatgcagcagaatatttgtgtatctcacagtgaaaagagggttttacaagtataaaggtaatacaaaatagaacagaaaattgatatgacaacatgaaagaaaaccttttatatttcaaaagtcagctttcagtttttcccagtaacagccattgtttataaccttggggtctaagtttccaggcttgtattggaacaggattagaaaaggaattatactatacattgggtgactgtgtcatcaccctctaggatgatttcttcttggaatgagacttaagataccatagttctactttcattgtgcattgatacattaagtcatttataacatttcccaaaactccaatctggagaactttctctatcaccagggcattgctttggaattcagggaggcctgagttctggatgggaatgggagtgagatggtccagtgaatgttaacagtcactattattatccttattttacagaggaggaatattctgctcctttatgagccaacatttactttctctgaattaaatgttactggtttcttatttatagacagcagagattgactgggcacactttcccccacagtttccaagactctgtaattatatgcaaaatagtaaaattaaattcaatctagatgaatccatatttcaataaggatattagtgacttaggtctaaaaattaaaattagactcgtcaatcctgttatgctttccattcaaatgtttttcctaaacagcaacaacaacaaaaacctgatttcctaatagtccatttagcttttatttcatgccatttacaaagtttaggcaacataaatgcactttatgcatatctctgtcccatatctcagtctagatagttgtctagataattttctagacaacctagataatcaatgggaaggctgaatggcagagcagaaaaaccatgtcttcagggtctgaactattgagagtaagtatcatctccaccacttaacaactgtacaactctgggaagatgtgctgggcaagccctttcagtcttgttggcttacccagtagtcaggatttgttgcaagaatacagtgccagctgtgttccagccactgctctcagggtactgttccctttccctttatatgttctgatatttctcccatagctaccaaccagcccattcttccagtctttctctgttcagatgctaatgggagagagttgatggtcttagatagtcaccataatccctttagagcagagatttgttgtagaagccaggccactttgaaggacacaggctgcctgatattctggctgcccttgggtcagatctcatccctggccaaagtggtgccaccactttctcaatgattgcttatttctccctccttcaacatgctttagaaggcagcgtttcccttagaggagcacagtgggctgggcagcaacagtggatgacgtgcgtattacggcactgctgggtatcatcataaccaacatgaacttgtggcttgttcttacaatgcgccagacgtctcatgaaacattcaacgtttcttaattcaccctcacaaccagaatgaggtaagtgttgttcttattcttattatttgatattttatagataaagagaagcttacagcatgaaataactttctcaaaatgataagatcagtaagcggaatattcttttttgtttttttttttgagacggtgtctcgctctgttgcccaggctggggtgcagtggcccgatctcggctcactgcaagatctgcctcccgggttcacgccattctcctgcctcagcctccccagtagctggaactacaggcacctgccaccactcccggctaattttttgtatttttagtagagatgggatttcaccgtgttagccaggatgatctggatttcctgacctcgtgatccgcccgcctcggcctcccaaagtgctgagattacaggtgtgagccaccctgcccggccagtaagcggaatattcaattggattccagagtttatgcttttagctatcaagctatactctttctcactatatttccctgagctttggtttccttatctataaaactggaaccgcactgcctgtttgcctttagagctataggtaataaatgttatgcatttattatggtaaataacatgtagtagagcaaagcatggaaattcaggaagtaacaaagagcagtcataagaatgtctatgtggtaaatctagataaaaattacttgtatacacatttacagtagcgcctttaaaacacacaccgatagcactttagtaagtcaagaatgcatgttgcaccaattagagaaaacaccaattttttaaaaaaacatataaataacaagctaatagaagaagaaatgtaattagaaaaatttaaataagcccaaaaactttaaggaaggacaaaaaaaatcatagaacagagaaaataggaatcaatggtaagatggtagatttaaccttgaattacagtaaatataaacagactaaatattgaaattgaaatataaagctcatcagagaaggtaataatatcaagcaaagctaaacaagctgcttactttaaatataaagatatcgacaggttgaaagtaagtaagggatggtaaaactactatgcaaagcaaaagttacaaaaccaaagcaaagactggctcgtttcagaataatcaacgtttcaggtttaatatgaaataatcgtaaatttgtttatacctaataacatagccataaaataaaaattgacagataaacaatcatgttaagagcctgtataagccagatttctccagaaaaacagaatcaaaaggatatatacattaagaattatattaagaaatttattttagcatattggcttacatgattgtggggctggcaagtccagaatccgtaggagaagctggcaggctgaaactcaggcaggaaacgatgttgcagactttaggcagaattttttcttctctaggaaaattcagtttttgctcttaaggcttctgattgtataaggcccattcacagtatgaaaagtaagatttatgtaaagccaactgattgtagatgttaactacatctacaaaatacctttgcagcactacctagattagtgtttgattaaataaatgggcagtaaaggccgggtgcagtggctcacgcctgtaatcccagcactttgggaggccgaggcaggaagatcacttgaggtcaggagttcaagaccagcctggccaacatggtgaaaccccatccgtactaaaaatacaaaaattagcctggcttggtggcgggcacctgtaatcccagctacttgggaggctgaagcaggagaatcacttgaacccaggaggttgtagtgaaccgagatcgcgccactgcattccagtctgggtgacaagagcaaaactctgtctcaccacaaaaaaaaaaaaaaaaaaaaaaaaaaaaaggcactaaagcctggcccccatgatgacacaggaaactaatcgtcatggagactttatccacacttttgaatatatgttacatttcaacattaaaacacacacacacacacaaaatcataaagcaatcaacaaaattaagctgaatgcttcgtaattgctggattccctgggaagctgactctgagatggagattagcgtgcaggacatttcttacgggttgttcttgggatcaatacctgtggagaggagaagctgaggcaggatcaggaagcggggaagtagagtgcaatgctggtgaagcggcatcactgtctggggtaaatatccggggttcatcatctctcgtcaagatgattaacgacatggacacacatgggtgagttaagaagcggaaagtttaataggcggaagaaaagagtgaggagaccagctctcagacatccttaagggaaaggctggcccgtgactg

SEQ ID NO: 2630 - DNA, 35062 bp, Homo sapiens
gtagcgcgcagggaaggctggtcaccccaccctaatcttgttatgcaaataggcttcccacttggcaggggccgtcttgtccactcgtttctgtaaacatgggtggcaaaaagagaagatggagctgccatttagaacatgcctaatcccaggtagtgttttttgttgttgttgttgctgctgttgtcgctttttgagtcggagtttcgctcttgttgcccaggctggagtgcaatggcgccatcttggctcaccacagcctccgcctcctaagttcaggcgattctcctgcctcagcctcctgagtagctgggattacaggcgtgagccacagcgccggccccaggtagtatatttttattggcacaactgccggtatttgcctgtgcaagctttcagcttgcttgtctgtgtctgcagctcgattttccaggttgctttttgttagaaaagaaaatgatttgggggctgcttttcattaaaaggaagaccttactgaggactcccataccttcactatctgcctaagtactttcttcttaactcctatatcactgggtcagcagcaaccccagtcaaacctcaagggagacgggaagatgggacgatctgtcagaggtatgctgagttgaggcaagagagctgacctttatggattgccaatcagtgactcattggaagtggggcaacctggaaggaaatgtggccttaggtgaggcagctgtcttcagaggaggcaatttctttgtatctggaggggcaattgttagtgttcccctggactgaagggtgaattatggagaatggaatagaacgatttgttactatgatttggttgatgacttatttcctgtttccttagcttcatcttgctgagcaaaaatgaaggagcctggacccaactttgttactgtgagaaagggtcttcattcattcaagatggcatttgttaagcacctactgtgagtagatgatctcctgtcaaagacagttaacaaatcctcggaatattgcttcatgtacagttattggagatgagtaacttacattctcttaattgtaatggttccttggaaagtcatcgtggaaaatgaaggctggctcatacattttcccagacaggaatttggctgccaacagggaattctaaacaactaaaaactccagatgatgaatgcacaacataatgatggttaaattaaaaaaaaaaaagagcacggtaataaaatttccatgaaatattttgtgtaagcgcagataatcagtcattttctttatagaattcttattcgtaaataatttagaatactttgttctttataatatatgatgggcaactatagtatgattcttctgagtgactcagttcttttttttttttcacatttaatgactttgtttctcctaagtgaatgcacagatagtatattaatcagggttctctggaaaaaccagaaccaatttattatcaggtactggttcatgtgattgtggaggctgagaagccccatgatctgctctctgcaagctggagacccaggaaagctgatgaaagtcaaaggcctaagagctggagggccgatggtatagattgcagcccaggtctaaaggcctgagaaccagaagcacagagggcagaagatcaatattccagctcaatcaggcaaagagaaaaagtcctcccttcctctccgtttttcttctattctgaccctggatggactggatgaggcccagccacattgaggagagccatctgctttaatcagtccaccaactcagatcctgatctcttccagaaacaccttcacagatacacccagaaataacattcaacctgttaggagtatcccatggctcagtcaagttgacacacaaaactaaccatcacagatacacatcaaagttaaataatattaacacagactttggcaagctgtattttaaaacacagtaggttagtgagtctggtttaagagcactagatgaaaccacatataaggatgtttttgacattctgtgtctgacccttcagactccctgccctcctccccaccatgttctgaaccccagaacactgacctctacgaacagccccacatgggctctgttaccctctggcttcccattggcccatggaggcacagaggaagttggggcaggaggacagaatggttgaggtacggatgctcgagctctcaaggccacaagtcggcaggggctacattcctgtgtgaagctcactacccctcagtcgtctcctctagctctctgtggggtccggtgacctctctccttacagtcccattagccctaggggaggtaatggctctccagggagtgctgcccatgggtgtctcagtatcacttgttggttcccatagccccacccacacctgtgtaaataggccttcattaaccttagctcagttgcctggtttgagtgtaccatctgtttcctgccagcactctgactgataacagcatttttgatataggtctccatcacatgtatgtacctttgtgtcctctgtattcctcattgatcagggttataaattttctcttcctgtgacactaaattgcccttaataaagcttattgaccctaaaagtcaaagggggcaaaatcagagctagtctcaattccttaaagtggacattatacagaaggttaggaaatattaaatacaagtattcacatatgtgttccccccgtcaagctaataaacatatgtatgtgctttttgaaaaccagtgtaaccgcaggttgtctcttgttcctagtaggtgctgattagagcaatgagttccaacttggcagtttttggaaactgaacatgagctgttaatgtctctgcatcaactcgggtttccttttgcttttgtttaaattgaagtttttcacttaatataagatttagagatttctgtctcagagctcgccaagatttgctacttttgtctacccttgtttttaatcttaaaaatttggatttacttaataattccaagtatgaacattaatgttgcttttatcttccattttactgcacaggaggaggggaacagataccaaactactgattattttacttccattgttaatacacatgagaatataagtcttcttgtgtacctggaacttacaaaaattggtttcagctactcaggaggctgaggcaggagaatggcgtgaactcaggaggcggagcttgcagtgagccaagatcgcaccactacactccagcctgggagacagagcgagactccgtctcaaaaaaaaaaggaaaaaaaattggtttttaaaaaattacataacatatgtaatttttaaaacatatgttttaaacatatgtaattttcaaaaaaaaattggtttttaaaaaattacataacatacttatgttaaaatatacataacataaagtgtatcattttaaccattttttaagtgtacagcctaatggcattaagtacatttgcattgttgtgcagctatccctaccatccacctccagaacctttttttatcctccaaaattggaactgtgtacccattacacaataatgccccgttctcttttcctgtaagcccctggcacccaccattctgctttgcctctaggaatttgactactctaggtacttcacataggtagaatcatgcggtatttgtccttttgtgactggcttattccacttaccataatgtcttcaaggttcatccatgttgtattaatagcatgtcttggaattcctttccgaaatttctaaggctgaataatattccattgtatgaacagaccacatattgtttttctgttcatctgttgatgcaaacttgggttgcttctaccttttggctgttgtgaataatactgctgtgaatataggtgtacaagtatttattcaatctttgcttgcagttctttgagctatatatgcaaaaaatgggatcctggattatacagcaattctatgtttaattctgtggaaccaccatattcttttctgtggtggctgcaccattttatattcccaatagcagtgcgcagaagtttttccacatccttgatagcacttgttattttctgttttttgttttgttctgatttatcttttgacatggaacattcttatacatggttacacatccattatggtggtcttcatcaagttagaggctgcaaagcatccatatcattcattcttctagggttaaaggcatttgtaaaatatcaaattcaataacactgctaaatgtcttaaactttgtgtgtgggagggcgtaactactggattttataagtgcttattacacttgaagatgacagatttcttttctattgaacattttaaagaacaatttagttcatcccaactgatattttctgaaggccgctatgtaccaggttctgttacaggtgaatggacccatcagtgaacaaaaccttaaaaaaattacaaatcatttggaaatccactattacagtggcttcttcagggatgatactgttttccaatatgctacctaggaaatgtgcttctttccaaactcactgttatgtctcaagcgattagttcatggctcagaagaaacataagtgagaggtgctccttctacagcccttactttgtgcttgtttctggcactcaccactttcgaccttgtcattcgtgtgcttgttttattttcttacaagactttgagtttcttgacaggatttcatctgtatttgattttctacaattatctgcagcattttgcatataagcattaaaaagatttatttcatttgctgaataataatgaacatggctgttttgtattctttttatgagatggtcagtcacatgcagccacggaggagacacaggggaggctcaggaagacagagtattatactcacaggtcctacaaagaggaggcacgccatgccacgcaggaccacacgggaaaaaacaccagagtggtcaggaggcaggaggcaggagctcaggaaatcattcaacctttactgaggtttcgcgggaaaggcaggtgagcagcttaggatgggctagtttgaatcatcctggtgggctctaagctctagggatggccctagttgtctagtacccagctctggaatggttaaggcagaaattttaaaaaatgaaaatttaaaaaatatatatgtgtacaatatcatacacacatatatacaaaataatacacatatatattgtgtttgtgtgtacacacacacacacacacacacacacgtgacaacttcatgctagggagaatggtgattctagacatcctgaactccagaatgatggtgaaataggtaatgcaagtcacctccccacctgctcctgactcggtcggctccctcggtgggtgagagggttgttggtctgccctttggcgccctctaggtgagaacactgcataggccattctggtctcattgctgcagtttgtacttttcataggaaaaaattagcaagctgacctctgttttggaatgcctcagaagctagaatagaagcccactcactctcctacagcacccctttatccccacacacctgtctttgctaggtaataagcagatgcggcttgcagacacaaagcgtgaatacgattagtaaattcaccttgtgaaatgcagctccaccttcctctaatttggccttaggggttgttttgctatttttatgagtctgtatgtaattagccacaattaaaatctgaagtctctaagtattttcacagtccaatttcatctgaggcaatgaaaaataaataactcacagtgactttattacttctgtttctcagatttggggaagcagaatagtgaagtgggtctcttcacacatccacaggacaggtaggattcgcaggggcttgaaagtcccataactcaagtgcatttcacctgtactgtcaacactgtctatgggcaagacttaaggcagcaacgtccagcaattctttgtgtgcgaggatctcatttcatccttcttccagggaggagaggggtgagaaaaaatgactcccaaacctcttgttaccatcctgtctccacttctgagctctgtcattgtttatgtcatttgtattccagattccaaaaggatatgaaagatctgcctgagatctagtagcatatttccagctggctcttgggaatcaagaatatatacaaagcattgttgacaacaaatgtttatttactctgaagatggtttccccttctgtgtgagtcagggttctgcagagaaacagaaccaatgggatatacatagtgctgtggtttgaatgtgtcccctccaaatttcatgttgaaacttaatccgtattgaggtgatattaaaaagtggagccttttgggaagtgattaagccatgatggctccaccatcatgaatagatgagtgccttataaaagggctggaaagaaatggattaggcccttttgcccttcagccttctgtcacataaggataccatcaaaaaacaccactgatggagcattccctcactagatatggaaccagccagccttgatcttggactttccggactccagacctgtgggaaataaacattctggtctttataaactacctcgtcttaggtgttttgttagagcagcacaaacagacaggacagaaatacatgtaggaggagactggcttatttgattacagagagcaaggagtcccaccatctgctatctgcaagctggagaaccaggaaagctgagggttcaatttagtctgagtctgaaggcttggcaaccaagggagctgctggtctaagtcccggagtccaaaggcccagaaccagtagctctgatgtctgggggccgaggaagatgaatggaccagttcaaaaagagagagacagagaagtcctcctccctccacttttttggtctattcagaccctcaatcaattagatgatgcctgtccacactggtgatggtggatcttctgattcaaatgtgaatctctttaaccatcatagcttctaagttcccacctttcttccatccttgccccatcccttcttctctaacctcaccttgtcctcccttacctctatcctttcctctctctcctgcatacattttgtggaaagcctatgtattaagggtagacacaaggcaaaattgtttctctgttcatggaacttagatactactgcaccagctactggagaaagtattatgcacttgccaagtaatacacaggatttttgtcacttataaacacaacaaagctcaaaatctaccatcatcatattctccttcttgtcactcaaagtcacatcaagaggatgaattgattttgtcctcaggacaccttgtcatgtctcccaactttcctatataactgatggttgttactccagacttttattagattatcttcagtgttgtgggttgaaatgcatcttccaaaagatatgttcaagtcctaaccctgggaatgggaccttatttggaaatagggtctttgtagatatcatcaagtaatgaggtcttactggagtagggtgagccctaatgcaatgactggtatatttataagaagaggaagatttagacacagacacacagggggagaaggccatgtgatgattgaagcagagttggagtgtctacaagtcaagcaatgccagcaatcaccagaagctaggcgggaggcacccaacagactctccctcacaccccccagaaggaaccaaccctgcaaatgctttcatatagaaggcctctccagaactgtgaaggactttctcctgtttcaagccacccagttagtggtgatttgttaaggcagccctaggaaactggtacacccagtcagtgcaataactttcaaatagttctgcttgcctccaacactcacactccatgtgttcccatccttgattactgtggcattctgcacatggcactcaaagctgggtcaatgtgagccaagagaactcaggaaaggagagacataagagagaagaagaccctggagagagaggttttgagactggaaagtaatcatataagccattggatacttgcagaaatcttggggtggtcgctgaacttcccccagagcatgggatgggggaattcaaaggacagagaggcttctgttgccttctgcatgatgtataagaaatctcattgaatcctctctgccactgcatgggctggaactactacctgcacatacagttaggaagctgaggctctgtggggttatctcttgcttaagaatgaccgactggactgacaaagttcagccatagaattagagcccaagatatcctgctctataatgagtattcttccttaccacccttatatctctaaatcaacaaactgggttatttgtttctcttggccctgacttgctatttacctatctggatttccttctctttccctctgcacctggtcaaaagctgctcatccttcaaagtccagtttaaatttaattgtctctatataaatgttcctgagcaccttagcctgaagagacatgaatcagtcccactgaacaagactaactgacatgcatataatttaatttgcacaattgaacacctgctgtgttgtttcttcaattatgggcttggtctctttgcatcttttgttctgagttatttttttcacactgttgtaagctccttgggcagagtccataatttatacatctttgtatacctagtgggtctcagaacagttccttgcacacacaaaaaatgaggcaaaatgaagtcagatgtcttggttctcaatacagtcatctgttctggagttgttaagtgtaggatatcgaatgcttttcttaaacttcctggtctctgtctcctcttctttgacagtaggggtttgaaccagcgaatgtcagtttccttcagctctgttggactggggcactgctcctttagcttagggacacatgccgggaagagggaatgtgggactcctctggcccaatttccaggcacctggggccccagcaagcttaccttgtcagattcatcagatggttggactgtaggcatgaccttggtgttccttgcaggaaacaaaggccaggtgtgatgctggcagtgtgtctgtgtgtctcaggagtctctctgatgttccgtctgaactacatgtcgggagatgccagatctcaatccgacagatcaagccacatgtgcccagaaaggcttttggcgacatcacattcacttaggagctgtggtccatagggggctggggtatgatattctgaatggtgacggaaataagtgttcttattcttgtttacagtgcctttttgggaaaatgggtgaaataaggttctgtgtgagtgtgcatgtgcgtgtgtgtgtgttgaagtagggctggaatggaaacatggggggaaggatatttgaagctctgtagtaccgttccttattgaagtaacacccctcgcctaagtataaacttgtggatggcttccccagtgcaagtttataagtttgtaaaccccaggctctgcagattagatgtatgggcaactgaatttttttacacaagcagagaaattttaagaaatttaaagcataatcatgtacacccaaatgctggtggtttgtgctggcttaagaagcaagaatattcctttggttggtgtagcatttctctttactgaacagcattaaaatagcaacaaccgactatacacttcagagagaaccatctagacatggagagaaaagaatcaatcttgtttgtaggtagcaatgtctggtagtatccataaaatataacagccaaggaaatttcaagggagtggagcaatggagattttgtgcttaaagagggatcaattaattggcaatcatgtacaactctaggtataattatatagaaaacaggcaacatgagatcatttatttatttttatgagggaataattttattttatgctcattttactgaggctaatttcttcttattctaagaagtaaatgtgaacatgcctattgtgcatttgcaaaggaaattcaaacattgtctttgtttcagaagcaaatgctgtaaatgttgctatttcagaatgacttttatcatagttatagatgttctcatttatttgcaaatacatttaaagtgacaaaaaaggaatacttggggatttaaatagcatgttttcaactttaactgcatactgtatttagaatttaaaggggatctctgatctttgttttctcatacgttccacttgaggccacattattctagggcagtggtcctaatccacagattttagtctcttttccccacccctccagggcacatctggcagtgtctgggggcattttgattatcacaatagggagggtcccctagtacaggattctagtaggtaaaggccagagctgctgctagacagcctaaaacacacaggacggttcccatctacaaagaataatccagtccaaaatgtcaggagtactgaaatggagaaaccctgctcaaaaaaaaaaaaagaaagaaattttatttccttcttacaataatccatagttaatctctgagccccattttgtccacaacagcatggtgtcgtgacctaaaggtatatctcaaaagaatctctcattcttatcagtgcagaatagagaaattgtgtgcagcctacgtgtgatttgtcactttagtactctgtggtaggttatttgacatttcatgcttcatagtctgaaatgccctctcttagtatacccatctgacattttcgagagactaatgtttgcctaagaatgcttaaacgatggccagattttactctgagtgatactaccccctggaagtggggggaaaaaaagaaggagggaaaaaagttaagttttcattctaaacatcttcaaagcttgattggctttaataaggtatcattaattaattcaacagctaagaagggactgcaagtgttaaaaatcacggctgtcaaatgttatggcatctgggagccctagtggttggttacttaacatgatattttaggacaattctactctgcttaagcataataaaccggaaagacatgaacaaatgtcccaactgcttccctttctactcccaccccctgctctggaaagaagccctaacacctctaataccacaccactctaaaataaacccaaatgttgcacttattttactgctatgcattgagcattattatttggagatgctctatgctgcttcattaaagatctttcatatggggtggggaaactgagccacaggggatgattaaaagaaggaagaagtcagatgacttcggattctgttggctcctgactagagaacaccttaggaaaagcaatccttcatctgcagcacacagaagaaaccacattccgaacttctcggtgatgagccccgtttcctaacagtgtgaggttaatgaacctccttatttttggcagggtgaggaagtggcaagcagaaaaacctatcaaagggagcccagttccaaggctttaattgcttaggtgactattaagaaaagagcccccttctttcacagcagaaggatacagttctctgttcccaaatctggcagctattcctcaattatagaaagaagaaggaaattaaaatgtgatggattaaataagagggtgaaccggtacttatttcctaactagaaattaccatttttgtgcttttaaattgataattatcagcaccatactttattcacttttgtcataaggtccttccttttaattaaaattgagatgcttcacatttcttgcgttcccttaagaaaatctttcaagtgtttaagtccctgatattggaaagctttaattacagcatagaaaaagaagagtggaaagagctggggcggggggatgtgtcccttcatttcccgtgaacatgatcacactgggaactcagggaggtccagtgcatttgtcaacttgccaaacattatgttcattaaaggccagaaagtatccctggggggtggatacacttgagctcatttccaatcattttacctgctctgcctcatttcagagcccagtcagatcattaccagacttcccacattgtcctaaaaaaatgcattaaaattaagtcacaacagacatccaggtttgcacctgtatctcacacctgtgaggatcgcttttatattgaaataagacaaggttctccagagaaacagaatatatatatatatatatatgtatgtattaccacacacgcatatatatatgtatgtatacatatatgtatatatacacgttttaaattttattaaaaattttaaatatatttattttaagaaattgtcttgtgtgattgtaggggccggcaagttcaaaatctgtaagtcaggtcagcaggctgaaaacttaggcagaagttaatgctactgtcttgaggcagaatttgttttttttgtttgtttgttttgttttttttttcaggaaacctcagtttttgctctgaaggccttcagctgactgaatgagggccatgcacatgatccagttatcaaggagaatctctttacttaaagtcagctgagtaaattgtctaaaaaatacctccacagcacctagatgagtttgatgacataactgtgtattgtatagcctagccaagttaatacataaaactcatcatcacaggcatcaagctcaaatgttagggtttgcagtggactaatgcatacttaagtacctagatgacacccagaagggacaaaagccctgagcttccccactcagcatgctgccacctccatacccatgttgactctctttctgttttcaggttgtaacccacgtattctggttctgacctgctctattttctctttatcctcctggagcaggagtgaagtagcaagtatgttgagtcataagacagatttcactattccttgaatgctgacagaactcagagtcttatgtctcatgattttccacttgatttccatttctatgctttgggtaatgaggtttaacttgcctctccattgggaatacagattcctggaaggtagagaatcttattttctgtgtatagagttcatagttaggtttcaggtgatattcagaaaatacattcagaattttagagatgtatggagttgtgaaactagcaaaatattaatcattcttttgacacagagcctcactttgtcacccaggctggagtgcagtagcatgatctccactcactgcaccctccgcctcccaggttcaagtgattctcctgcctcagcctcctgagtagctgggattatgggtgcctgccaccacgcttgaccaatttttgtatttgtagtagagatggggtttgccatgttggccaggctggtcttgaactcctgacctcaagtgatccactcaccttggcctccaaaagtgccgggattacaggcctgagccacaacactctgcctaatcattcattttaagtgattaaatcatccattcatctacttttagtacatcctacatcctttttccttccttccttccttccttccttcttttcatccatccgtccatccatcgattattaattcaataaatatttactgttttccttcttttgagaggtgtatgacctaaactaagaggtatggagtttaaatgacttgtggaaaattagaatgttttattctctcgtttcccacaagtcatttatatagttgctaaaatttagtaactgcaataaaaatacatgattccggacaacatattctcattttacttacttctaatattgatatcagattggttctcctgcctctgagtctcagttgagatcagaaagcggtgataacagctcattgggaattggccatttgcaaccaaagtttgtgatatagttgggacaactaactgaataactgggtcacaataggagacatcttaaattactaaagctacatgattttggaaagtctggtttcatttatttaactaaactaccagtaataccttatgtttccaactttggtttttgtcagttgagatctggcttaatatccctcatggaaaagatggacaatttaggcaaaaagtatttataaagataaagtttaggcagggcacagtggctcacgcctgtaatcccagcactttgggaggctgagtcaggcagttcacgaggtcaggagttcaagaccaatctggccaacatagtgaaaccccacctctactaaaaatacaaaaaattagctgggtgtggtggtgtgcacctgtaatcccagctactcgggaggctgaagcaggagaatcacgtgaacccaagaggcggagttacagtgagctgagatagcaccattgtactccagcccgggcaacagtgtgagactctgtctcaaaaaataaataaataaacaaacaaacaaagtttaaagaagaagtgtatatttatgtattatttaattaacacatgcaccaaccgtacaactgccttcagaaagtacctttctgacaaaattagaataaaggagacatagtgggtagggaggagaggggttaggtgggtaaatttaggctatgccaaataaaaatggggcccctaggagtggggtgcctaggactagcattggcagaaaccactggagcctcgagccagcatccttttgctgaggcctctgcatagttgatagagcagtcccaaagatgtaaatggagcaattagatatcattcaatttatagtgctcttggcaagaaaaagatctttcagaattcttcatctgccctaggcaaacctttagaggctctcctcttgcttattcacacttgtggcaattttccaagaagaaattccactaaaaagagtctattttttaatccaaattgagaaaatggggaagtagtctaggatgatggtaggagttgaaattctggtgtcagactgccagagtgcaaaaacctggcccaggcctccctcctatctactaagcaggaagggggaggatgtgaagaggtggtggttgggggttggtttaccttggctaagctgctcctctaagcttccacattcccacttgtaaaatagagtaataacagtccttacttggcaaagtggttagaaggactagatgagccacttctgaagaagtgctcagtgcatagtaagcaagagaaatgataactgttgttcacatgtgtacagtgaatgggactattacatgaccatcacatcaatgataattacatttccattatttttccttttaactcataatacctttgggtatttagctggaatgcagcatattttactaaatggatacagtagaatgctccatttaataatgatatctactttgttttcttgtcctcaaatcaaagggacccgagtgcagtggtccagctattcaggaggctgaggtaggaggatagtttgagcccaggaatttgaggttagcctgggcaatatagcaagaccctatctctaaaaaaaatcaaatggagaaaactattggtccatattctatgttatagacaagatacaaaagacaaactcagattaatgcaagttaaccaactctataaaaattcatagaattttattattatttaaactgccttttctaccactgctatatttgttgactctgcctaggcatgctttaaaaattccataaacagctcacgcctgtaatcccagcattttgggaggccgaggtgggcggatcacgaggtcaggagatcgagaccacggtgaaactgcgtctctactaaaaatacaaaaataagccaggcgtggtggcaggcacctgtagtttcagctactcaggaggctgaggcaggagaatggtgtgaatccaggaggcggagcttgcagtgagccgagatcgcgccactgcactccagcttgggcgacagagtgagactccgtctcaaaaaaaaaaaaaaaaattccataaacatgtaaaagtatattcattactagatatccatcaacattgggagagaatctaaagcaacttatcccccattcttttacccagctgtattttctgctaagccacctatctcaatctgagattatattacacatttaaaattttctggtttatcatcccttcctaaaatgcatacctgaggagggtggggactcatttggtcttgcttaccagtgagcctctggtggactgataacactccataaatacatgtagaatgaatgtcaagtaaataaattcagaaaatgggcatttatgtttctaagttgaatatgtattcacaatttcagttaatacccacttgcttttattatttatcttgtgagatatgacatttccaatgcaagccttgccctactgaaaccatcatttgctgaatgtgtaattttcatcaaactgtactttaatattaatcaaaatgaaaagaatcctcttctaaatatttgttgaccttgagcttatatcatgtttgcataatgagatttaagtagaacatactttaaggtgcaaagagatattttttcatattctgtgttacaaacaagacacaatagataaactcagattaatccaagaaacaaaaataaaaaaatgaaagatcaagaaaaagctgttttttttaaaagattaacaaaatgcacaagcccttggtgtgattatcccagaaaaaaaataggacataaagaaataatattaagaatgaaaaaagttatctaatacaggattagtaaagatttttaatatcacaagagaacataattttgataaatttaaatcttagtttagacaattttctagcaattataattttacaaaactaactcaagaagaaataaaaatgtgaataaactactaattgtcaaaatattatatacaaactcgttctaagcctagaaaaaaaactgggagaagtcctcaacttattctatatggttaatataacctagataccaaagtttaaatctctttttttgaattatatgaattttatgaaaaattctaaataaagcattcataaattgaatattttaaaaccccagatacatcatgactcagggatgaggcttgacttgacacagaagaatctactaatgcaattcactacattaatagagaaatgtagagacaccatatgatcacctcaaaaagtgccaaaaaggcaataaaattcaatagttatggcttgtaaaaaccggaagtaaactaaaaacagatggagactttttcatctgataaaggatatccaccaaaaacaaaaataaaaacaaacataaaacaagtaaacacctacaaatctactgtgaatttctccctctgtggctacagatgagtaagtgcagggtctttggcagctaatagatctggaggagcccttgtccttttataggacttagaactttaagtacaaaagttccaaataagtttgacggaacaaataggcaccagcttgggcaaaaaaaaaaaaaaaacaaagctgagccttcatcacaaccatcttggattactgagcaggaatcctatacaagataatttttttaaaaagataaaacaacaactcatataatgtttaaataaacacatattaaagatttagcccattcgttaatgagggaaccaagatcttacagtcaattcaaagaagaattcaaaacacataggcacacacatacgaaataagaaatgctgaaataaatttataaataaatgcaaaattagtcaatatttccagggcaattgtgaactacatctccactgggtacaatttgtttgagtttttatcggcaggaaccagttggatgacagtttttgtggaggtgtgaagtagctcaaagacaacaaaaggcagagcccatgcagaaggtaccaccccaccatccgcttgcccattttaacatctttcacaatttctgttaacagtttaaattatattttgatgttgatctcttttaaatacttgattagggaataattttctttattctctgatgttgctgacgcttggcttaataaagagtttttattttcttatttctctttaaaacgtgaaatcagtggagccatatgccagtgtcagttagatatgtctatggaaagtcagaccacactcctgttgggccccagctggcttacctcaattgctagcaaaatgcttgcaaggaaaatgtggagacagcctaagctacagaaaccatcttgctttttttctgataacataagttttcaaagcaatatttaaacaaaagacaacatgttttttccccaagtaaatatctacagccttcctcccagcctgtcttactcccaaatcatgtccttgttatttgcaggtatccaaatgtctgcatgtgggagcattccttgtggattagggtgttagtgtctaggagtctcctcttttatgaaatgcaaacattctttgagcacaattgcaacatcagctgtgatatttacctaaatgtttcccaaggataagtggcttacgtcagagccctgaggctacaggatgtagggtttgaccagcaagagatttgagggcaggtaggtatcccatgagaaaaaaagtatcagagacacaacagcattatcccaggacatgaggtcctggaggttagaggcagcccacaagaaagcagtgatcccaaaaagagacaggaaggtgctaacgacaaaactcatctttgtgtctactcccaggctgatccgtgattaccaaaatgatccagtccacaatttccaatgctgaagacagaggaaagatttggggctgagagtgatctatgttgtttgtttatatacaagacattaggtaccctgggccattgacctcatagagaacaggcagcatttgttgtctgccaactctggattctgcaggcatcaaaggattagactctcataatgaaatcagccctttaagctactcggaagacttacgatagggatcactacccagattaatttgctaccaaatagagaatgagaggccaagataaacaaaagagagcagccagctggtagggtttgaaaaaaaaaatgcaagccattcattttccttttgttcttgtatttccaattgaattatgatggctcatcttttctaacctgatatgagctgaattttttatgatttaaatttgctcattatatttctattgcagagtggttctctgaagaacgagcctgttgctggctgtcagggtgtcatgatggtattgcgcaaatcctcgaggcagctttccagggctgctgtcagcctgctcatgccctttagccactgggcagtaaatgaggatctctaggactgaatacataatttgagggggttctgtgcaaaatgaaaatgcaaggtaccttgtaaaaaataagactttcatcagagcaacagggagcttctgggtccaggcctcaggccacacacccatgaagttgaccctgggggtctcagtgatgggataagcaaatcctttcccacagcaattacataaactgtcttgccagggactgaaggcttacaacttgggagtcagatacactttgtagctcagaaagctgactttaataaaagtagtgtacctagaagacagctgtttatttgtagaggtggcttgatatgttttgaatttgtgtccctacccaaatatcatgtcaaattgtcatccctaatgttggaggaggggcctggtgagaggtgattggatcacagggagggacttccccttgcttttctctcaataatgagttctcacaagatctggttcttcagaagtgtgtggcacctcccctactctctctttctccttctccggccatgcaagacatatctgcttctccttcaccttccactatgattgtaagttccctgaggcctccccagccatgcttcttatacagcctgtggaactgtgaatcaactaaacctcttttctttataaattacctagtccctgttagttctttatagcaatgcgagaatggactaatacatggctttaccttagatttcttggaatctgtaagttgatccaaattgcttgatgaatgtattctctagggatccatgtgaatctctctttgagaagatttttctcttgtggcttcacttagagtctatctacctttacataggtgcatttatattgaggtgattgattatttgggtaacagctccatgtatactatgatagttataggggccccatttgtattagggtttgtaattctgtcagcatgaagcaatcatttcaacggacaatatttaatttttaatgtaggatttatctaaccaggttctgcagaggtgttcttggggtgctccagtgctcaagttaggaaaacgctgctttaggtctaagtcaggttcgaatcaaaggttttgaggtcttagtgattaataagttctgtgccccttctaatgacggtatgtaagtccaaatgccatatgcaaatcaaatctttgaaggaattgatagaaaatggcaatcttcattcagataagatttagcctagtggttaaaaaaaaattccaaataaccaaatattgaggaataataatgtagcaacaacaacagttttgagtactcacagcatgacagatacttttggtgtatttttccagtcctgtgagataggtccttgttgatcctccattttgcagatgagaaaaatgaagcaagaaggattcagtaactcacccacgtctccaggcagcaggaggcagaagtcaaatttaattccccagaatctgactctaaagcaagtgctttaccctctcaatttcatttctctacacacttgtgctggaaaatgcatgaaagtttgcatgatttcacactttcacatgagcatgaagatcagaatttatggggatatgattgttttaaattgtaggttttattattattcaggcatagtgagttcagcagatcaggagatgactgccattgaaaggatggtttattactcacagttcccaagagcaggaggcagccacaccatacagggccttttggggaagtgccaggattggtcaggaagcagaggggctgggaggaaaacatggacaagagcatttattacagtttctgtgagaaggaacaggtgaggcaggatagacagacttaggattgtctggtttaataattccaaagggctctgggctgcaggggctgtctctcattgcctggtacctggccatgggatgatttgggcaggtgaatggtgggggaggcttgtgagaatctgataaagaaggtctttggggcatgggctctgggttagttggtttgcatctggaagacacccttgtaggcaaataatttactatctttagaaattggctatccctgggaggggcagtctctccagggtcagcaaggccccagatgtcaaagcttcagaattagaagatatgcttaatgcattgacctggaagacctgggctgacaagagggacagggactgctgcctggtctaaagagtcacctcttaggaccagtgtcctcccctttgttaaaagaagacaaagagtccttgaagagtgatcataaaaagatgatgccaaagtgtcttggggagacagccacatttttcagagctgtagccacatgtctcaaagatgtagacttgtgggtaaatggtacttgaagcagaaagcaaatgtgacacttagtgattgtaagtaatcaagatgacacttcttggtaattaggcagagacgataagtaattttttaaaagtttcagatgcctattgcttttgattttctctcctctctttgttagtctcctaatgtcaataagtagaattcatgccaatgacacctaacatcagtcctttctccctggcccagcaaataaacaaaaacacagaggaggctgcctggagaactgagtgttgcctctcacctgcagcacacaggacaagctgggttcttcgggctccacattagaggtctctttcaaccagtacccagatcccagcccaccttctcttggctgagttctggagcagacttccaagtgctcttttatttctgtttggaatctgggagtcttggtggttgaagacataaggcaccaagatatctgggcttggaggggaggattctagagttctaagcaggggcactaagctctagcattgagaagtagaaatggaagagaggagagggacgagtattgtgaacaaaaagttggggtggctgggttttgtacacccagaggttctcaatgaatgagtctccatcagcccctgaggcttcctctctctcaaggggcaggagaatacctggaggaagtggggtaaagaggtcatggagattagcagtttttcaccctttgaaagtgttaggccatgtgatggagcctccagacccagaatctcatttagtccttatacaacctgaaaaagtcttccaaaaccttaggggcaaacacatcccatctctttcatttttccccccaatgaaaatgggtttatcctttaagggcactcttatttggaggtccagtactcccccctttgatgttctctcctcctcaaattgtccacaaacctagagggctgatgtggtccaaatggacccaggtttaatcaaactgtctccccaatgaaagctaagcttcagttggtgctcgctgccacatggcttgagctgagtgctggtcctttccacctgaaagatactgccgggcagctgctgacccaagctctttcccaagacattgtgtttttttaagagtggccaatgatactcacttggagctaaactcagctaataggatgccatgatctgagggcctctgcctttagagctcaaccactagaacaaaaggtctctccctaccccctccttctaagggtggactccttgctactagcagggagccagacagtcttcttagacgttcccctgaaagtaaagctgctacctgctcacccttaggcagctacacctgattccaagctctttcagtatcttgaaattgctcgattctctttctttttcgtttctcaatatattttatttttagagcagtttatgttcacagcaaaattgagaagaaagtacagaaagtttccacacacccccagtctccatacatgatggcatcaccctagtcagcagtccacaccagagtggtacatttgttacaaatgatgaatccgcactgacaacttataatcacccaaagcccatagtctaagttagggtcactctcagtgccatatattttatgtgatttgactatatgtaatgacaggtatccacagagatacctgtatgacagagtgccatgcagaacagtttcactgcactgaaaatcctctgggatcctcccattaatcactccctcccaccaacctcttttcattgtttccatagttgtgcccttttacagaatgccagaccattataacaacacagtatggagcctttttagattggcatctttctgagttttggaaattatgtaaaaacctgctctacatgtccctgagaaggttttgattggatataagttttcaactcgcttgtgaaaataccaagaagtatccttgatgaattgtatggtaggaatctgtttagttttgtaagtaacagccaaattgtcttctgaagtgctagtaatatttttcataatcaccagcaatgaatgagagttcctgctgccccacatcctcaccagcatttggtgttgtcagggttttatatcttgtctgttctaataaaagtgtagtgccatctcattgttgctttgacttgcagtttcctgatgacatatgatgttgagagttttttcatatgctcatttgccatatttatatcttttttgacagagtgtctgttcaggccttttgcccattctttaataggttgttcatttttttgttgttgttgagttgcaagtattctttgaatatcttgaataatatttctttccagatatgtactatgaaaatatttttcttccagtccatggcttgtcttctcattctcttgacaatgtctctcacagaattttgggtcttttttgtttgtttttaaatttcaatgaaggtcagcatattaccactgtattcatggtgaattagattttctcctgtcttcttctaggggttttatagttttgtgtttacatttaggtctgtgacccattatgagttaatttttgaaaggggtgtaagggctaggcctatagtcattttttttttcctgcatgtggatgtttagttgttacagcaccatttcttgaacagattatcttttctccattgtactgcctttgattctttgtaaaaaatcatcagttaactatatttgtgtagatctatatctgaggtctgtattttgttcctttgatctatttgcctattgttttgccaatacaacactctcctgatgattatggcattgtaataagtatggaaggtgaataatatcagtcctttcactctattattctttaatattgtattgattattttgagtctttttatcctcatataaactttagaagcagtttatcaaaatccacaaaataatttcctggggtttagattgggattgtgttgagtctataggtcaacttggacaaaagtagcatcttgacaatattgagtctttatagaaataaaaataaaatatttctccatttatttagctgtttgatttctttcatcagaattttgttgttttcgtcttgtacttattttgttagatttataagtatctcatttcagaaagtgctaattttaatggaaaacaatttatttttaattaaaattcatttttaattataatttaatttataggaaaacagtttaattttgttaaccttatatcctgtaccttattataatcactagtttcagaaattatttttggttattttggattttctacatagacaacactgtcatttgtgaaaaagagcagcctatttcattcttcacaagcaatatatccgcttttctcatattactgcattaagactcccagtaaaatgttgagaaggggtgctgatagagaacatccttgccttggtctcgacgttagcagggtaatttctagtttctcaccatgttggttatgatggtagctctacattttttaataatattcattatcaagttaaggaaattctcctgtattattgagctggtttttaccatgaaagggtattcgattttctcaagtgctttcctttctattgatagggtcatgctatttttcttcttcatatataggatggattgcattactttctttttatttgttcatttatttattttcttttcaacttattttaggttgaaagggcacatgtaacaggtttgttacatgggtaaattgtgtgtcatgggggctttgtgtacagataattttgtcacccaggtgatcggcctaatacctgatagatagtttttcaatcctcaccatcctcccactctcaacggtggactggataaagaaaatgtggtacatatacaccatggaatactatacagttgttacaaaatgagatcatgtcctttgcagcaacgtagatcgagttggaggtcataatgctaagtgaattaatgcaggaatagaaactaaataaatacttcatgctctcacttataagtgggagctaaacagtaagtacacagggacacaaagaagggaacgatagacactggggtctactctcttaagaaaaggcaagatgacattccagtgtccacctggctagaacagaaaaaggaaaaaaaaaaaaaaaagaacattgactcattcccagggcatcttcctacacttagattctgaaagatagtattctttccatcactcctttcctttctactcttagcacaaatatccttaaacagaattttagagccgaagtcaaagtcactttgttccacatacataccccaacatctgctacttgttctcttgatacttaaattcacttaacaggagatctggccttttttccccaagctttaattaatggttaaatcttctgaaaggctagcagaagtaatctgttagtgcaattgggtttcactcctaattcttagtgtcattctacagttctttctcaagccgtgacctgtgatcaccatgatcagggattggcaaactacagctcatgggtcaaactcagtgagctgcttgttttgtacgagctgtgagtgtccacaaaagttttattgaaacatagccatgcttcttcgttgtccctattttcaaagaccagttttgttctatgacagcagagttgagtagttgcgacagagactgtatttcctgcaaaatctaaaatatttactctctgactctttaccaaaaaaacccccaaaaaacaaaaaaaaaattgctaactcctggtctaggtagtgtgaggttcagtttctggctccagcactcactattggggaggcattaagccagtgccattctcctaggaagtgctccacatagcagctattggcacacaagtcatgtggagatggggaatcctaaggaaaagaacgatcgactttggataaacttattgaacttttaaattctgacagtatcctgcttatataatttctgcacatatggaatctgcatcctgagtttttttctatccagttcatgtttgtacaagtatcttatatgtgcagatgatgaaacagtgcctttaagcaaatgcctttaagcaatgcctttaaacaatgccttgagcaaaatgatgtatttgagtgagtttattgtcagtattaccaagcacaatgtttgactcctgctttggtaatgtcaggaagtgtggcagatggtggggagacaagaggagtcattcaggaagaagccaggagctcccaggataaaagaagcaattaaaatgcaacccttggatgggctcaaatgcagtctgcctcctcttccttatcacgggccagatccagtctttcttaattgaaggggtcaagctaaagttcttatcaacaaaagtgatgttgcttaggaaagtcatattccttagctaattttaggtgctgttttgtgcttcctgtgttaccaaccttctaaacagtaaataagagaacattgctgtctataaaaaaatcttttagttgtagtgtcaacttacaaaagaattgacaaaaaggagtggaagttcttttaagtccttgccaggctgcagagcagagctagaagaacataaagtcttaatcctttccctgctctttaccttgggggtggtggatgtttttcagggctctgtgggggactggcgtggtgtttggtcatgctgactggggagccagatgatctatctgagctctggtgttggctttgccatgtattctgaaccgtcgaatcaacccctattccaggatggttgattttatgtgtcaacttggagacattttgggatgaaattaacgtttaaattgatacactaagtaaagtgcattgctcttcataatgtggatgggcttcatctaatcagttgaaggcctgagtacaacaaaaagaccagcttccccgagcaagaggaaattcttcagcaattgccttcaagagttcatctgcaccattggctctcctggtctccagcctgctggtccacactgggacttggacttgccagcctcaataatcatatgagccaattctttataataaatttatttaaatacacacacacacgcacacacacacacacacacacacatgcgcatttgatttctctggagaatcctgacaaatttaattctatgaatagagtaaaagtctctgttaacttataataaagttcctgttcattttaaaataaaaaaaggtactattggctcctggttgagtccttgaccatcatatgcacacatgctttaaccccagacagacagcttcattcttctttcttgcacaggcaaaacggcttctcatctttggagtagtcgagagtctaggtgctggatccagactccctaggttcaaatccgagctctatcacttggtagctttgtgaccttgggtaaaccacttacttactctaggcctcaattccctcatctgtaaaatggcaaaataagaatactcaccacataggattattgtgaaaagtaatgacttaatgcaagtaaagcgcttaacaaattatctggcactcagtaaatgcttgtcccacttagaatagacctggtttgtctgcagtgatgaaacatcagtctgctgagaacttggctagaaatgcttaagtagttgagtggagccttaaaagaagcaagtaaaaaaaaaaaattctgctatgtgcctgaaggagggagaaatgaaatccttggcaaatagaatgaataatttccccagttactattattaatatgtattatgtggctagcttcaccttgttttcttgctcagggaaaataatttctttgaatattagattgatgcttctatcaaaaagcatcttctctgtcctgtttaacagagaaaacatggttcccctcctccagtagttaaagccctgagctgtgtcctccagtgcccaagcagatagcatttagtatcttgggctgttatcaaggagcttctttatagaaggaattacaccttcggtggttgggggtgggggaaatagttaaaatgcaaatgtatcagtatttactagcttttggagctcacgtctcgcgcatttcattctgaactttttgctcaatgcctctgaaatcacccttgctaatttaggcccctcggaaataattccaccaaggcagaaaattggcaaccaaagaagtttcactggcctttagatcattttctttcttaacttgtaattttccgttgctttctgttctccattaacttttcatttgtccattatattacatgtgtagtggcaaccttgattttgatacatgatgtatattcactgagcaagggggttgatccattatgtggaccccttctgggaatatgtggactgtgtctatcaatttaagaatgttatatatggaaacataatgagtattataaataagttttaaaaacctatgcacacagataatgaacttcagggacattttaaatgaattttccttgtttttagctgaatacccaataagagtctaggtatattataggtgagtgatctgtgcccttgataaccttgaaatttggaatttttgtactgaataagattcatgctaagcatttaagggcagtctgttggattcatggcaagtgttatctattggattcataagatggatcttggagaactttttataaatagataatcccatgtgctatacctgtgagattcctagagcatagagataatcgctctttcaccattgccatttataaatgtgaaaaaagtctgaaaactcagtgaggagccttaaagaatgtctaggcacccaactcttgatgcatacaagctacccagtgtaagaatgtgcatcttatgaatactgaatattcagcattggttgaaaggtgtgtgggataatcgtgtgatagtgggaggaggatggcctttattatttgtaaatatgatatttaatgcaacccaagttttaattttaagccatttctcattagtgcatcttcatatgaaatttgaatagtatgaaatcaattatgcagaggaaaagtacttgactattgataggaagaaggaatgctgtattaggagtcaggagacatagctcagtacttactcagtatgtgactttcaacaaacaattgttcccctctaagcctcagtctcctgagttgtaaaatgaaagaatgacactggatcctgtttctaggttcctttgcactttcaaaatctttaagaatcttttgttgttgttgacaaaaggatttaaagagtagggacaagtgaccatccataagtgatgaaaagaaaagttaacccaagagatacataaagtggggaagcagcagagttacagttggagaaaccagggagtgaagtcgaggtgtgccacattccctctagatgactcttgaagggttgggtttctcttctgtaaaacagagaccatagctcagaggtttgttataaggattaaatgagataatgcataaaacatgcttccaggaataaagaatcatggaagtgaataaggaagaaaggagatggaggaagaggaggaagagaaaatgacttagaaaatgtgtgattaactaagtaattaatccttctaaaactttcacattcagccaaagcacatttgtgcatacaactctcatttgtctaccttggaataatcaattttgtgagttattcacagaagatgagtgaactcagccaggttttctaatactctgctaccttcttgttcacctattttctgactaggaggcatgtaactcaagttttcatcagcctaagcccaaccacattttggagacatgtctgcatcacaaattatcttgggctttcaaaaatcaaaaataaaccactttaccaaaaatcaatcccactccatcactttggtttctctgtgccttgtgcgccattattggcatgaggagttgtgagctaaccgtgccacattttcaggagcctttgtgccatcctgtttcagcccttgacaggtgctcctgcggggttctcaagctttccttttgatttccccaggatattatcattgtggctggtcaagggaggggacatcctgagaaaatcagccaacagttcctcctggaaaatccaagctctctgattagaggggcaagaaatccaactgatatgtatttaagcacttttatagaattcccgctatgtgccaggtgcacatagttcctaggtaataggatgcagcagccaactagctgaccaagtcctcttgaagctaacattttagtggagaatgtagataacccctcaaaaaattaataaagaagaaataaaatttttgataatgggatgtattatgaagaaaaataaaagcaggggaaggggcagtgaaagtgatggggtggtctggaaaggtcgatctgaggaggtgatttttgagatctgaatgcagtgggagaacaagccatggggaggaatagagaaaaagcaatggaggcacagaaaatattaaatacacagtgggtggaaacaaacaattaacttggccagtgcagctggaacagggtaatggttgaaggacggagcccattcaggtaggcaaaggttggagtttcaagaccttgtcagctaaagtaaggggtttggatcttatcagaattgagatggtaatctattgaatggttttgagttggagaatgatgcaacttatttgcatattaaaaagattactctgactaacatattgataacagactgtcatgagaccagagtggaagctggttagtagatgactgaaactgtttaggagagagaagaccgtgcatttcactagagtagttatagcaggggtagtgtagaataatgggattcagtacatattttggagaaaaatccagcctgacttttcgctgtgtttatgtgggacgtaaagggaaagaaggagtcaaggataactgctaggtttctgtttttagcgactgggtaaatggtggtggtgttaactgaggagatgaggtgctgtatcagtgaggactcatgcaggaaaaaaggaaccactccaggtgtattaagtatgaagtggtttaataaagggaatcgagtgctttcaaaagcattggattagctgaggaaacacaagttagagaaggtgcccggtagtatttagttctgctgtcactgcttgggccagtgaattcagaagttgttgctaccactcagatgaggaaagtaaaggaaaactagtgctgccctacagcactgagaagagtaactggaatggatcacccagaagccaccgcaaaaactcttgtctgccaaagctttcgtgtcctacattgatgcatggggaagaagagtatgttctgtgctctttcatctttgaaatctctcactagtgcacctcattagcagaatatagctgcaaccagaaactgaaaggcagaagaatctgacagataaagtttccagcctttcagctggcattgcaaaagaaagcatataacacaggacagaggagagcaatagaatcttgtaggctaagggacagataataaaatatttgtattgttatgtcataaatctgtgtgtctatcggacatccaagcagaagtgtcaagtaggaagtagaatacacaagtccaggaatcatgggaaaggtcaaggatggaaatataaattggggagccattagaacataaatggtaattaaaggcatgcaagtggagagtattacctaaggagtaagtgtagatagagaaaggtcttagaactgagctccatatgcttcgggaaaaacttggacattggggaaattaggaagcacttctagggttaaaaggactgaaggccgtgcacggtggctcacacctgtaatcccagcactttgggagcctgaggcgggtggattactggagatcaggagttcaagatcagcctgaccaaaatggtgaaaccccgtctctactaaaaatacaaaattaggcagtcatggtggcatacacctataatccctgttacttgggaggctgaggcaggagaatgacttgaacccgggaggcggaggttgcagtgagccgagatcgtgccattgcactccagcctgggcaaaaagaacaaaactccatctgaaaaaaaaaaaaaaaaagacaagttgggactgggacctgaaagaagctcagacaaatggcttacatattgcagtcaagactacaagagggcttagaggtcaggaagaagaggagatgccagtcaatgcgactgacaaggtgggagagcagtctacagagtatggtcctctgaaagtcaaatgtcaaatactgatgagagttatgttttgttttgcttttgtttttgcttttgtttttgttttgagacagtctctttctgtcacctaggctggagtgcagtggttcaatcacggatcactgcagcctccacctcccagttcaagaaattctcatgtctcagcctcctgagcagctaggattacaggtatgttccaccgtgcctggcctgatgagagtttttgttttttaaattaaattaaattaaattttacgttctgggatacatgtgcaggaagtgcgggtttgttacataggtaaacgtgtgccatggtggtttgctacacctatcaacccatcacctagggattaagcccagcatgcattagctatttatcctgatgctctccctcgtttcagcccctcgctgacagaccccagtgtgtgttgttcccctccctgcatccatgtattctcattgtttagctgccacttgtaagtgagaacatatggtgtttggtttcctgttcctgtattagtttgctgaggatgatggcgtccagctccatccatgtccctgcaagggacatgatctcgttcctttatatggcttcataatattccatggtgtatatgtaccacactttctttatccagtctatcactgatgggcatttgggttgattccatgtctttgctattgtgaatagtgctgcagtgaacatacgcatgcatgtatctttataatagaataatttctattcctttgggtatatactcagtaatgggattgctgggtcaaatggtatctctggttctagttcttggaggaattgccacactgtcttccacaatggttgaactgatttacattcccaccaacagtgtaaaagcattcctgtttctccacagccttgccagcatctgttgtttcttgactttttaataatcgccattctgactggcgtgagatggtatctcattgtggttttgatttgcatgtctctaatgctcagtgatgagagttttaagaagatggagtatgagagttcaacactgtatttggccagatggaagccgtaggaaaccttaagcagagtagtcttcaaaatcttgaatgaagtggatggaggtggggatagagaatgtgcagtgagcaaataaagagagaatttacacaattctttggactcattgtgatgtaatataaagagagcagaaaaaaagagcagcagttggaaatgatgtagaatctggggagagaccttttaaagaaaggtgatatcaaggcttgtttgtggactgagaatgatgtgtgatcttggaagtcagcttgagaatggagcagtcaagacacaaattggttggcaggtcatgatcagcatgagaggaatctctatcctgcttccaggctatccttggcactgtgatttttaataaaataatgcactgactttgcattcaaagaaattactggacagtcaaaatatacacacatatgcaaaaattgaggagcaatttcccataagatgtaagcaagagtaatagttattttatgttatttctgtaagtgttagtggcagtaagtaaagaatgaattgtaaaattgtgacagggaaggtagaggagtgctttttgaaacctattttccattagatcttaaagaaagttgagaacataaatttgtggagaagtgagggtgaagattcttaagggaggcagaagcaagatttaataacaatgcagaacaaggaatcagcaaaacctgttgaaaacgtcagaaaacttaggggaagctggagcagagggttagagttgggagacctgagtgagggtcttggctttcactcagtgtgcagtcaggatccacctaatgtggaataaccatggggttctggaatgggctgagacagtgacatatttgcccatattagtggatccatgaatcattttctacaaagtcttcttgttttgtttttcagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctca

SEQ ID NO: 2631 - DNA, 35062 bp, Homo sapiens; identical to SEQ ID NO: 2630

SEQ ID NO: 2632 - DNA, 35062 bp, Homo sapiens; identical to SEQ ID NO: 2630

SEQ ID NO: 2633 - DNA, 35062 bp, Homo sapiens; identical to SEQ ID NO: 2630

SEQ ID NO: 2634 - DNA, 35062 bp, Homo sapiens; identical to SEQ ID NO: 2630

SEQ ID NO: 2635 - DNA, 2490 bp, Homo sapiens
tggcaaccaggatagaagatcagttgtgctgggggaggggagccagccaggttgtagaaacagcatccctgactttgttctgctaactgtgcagagagaggtgatagtctccgcccaggccatgagggacctggaaatggctgatgacacggtggagctcggccacaccaggcccagctggccccacagcaaaccagagggtccaagtgggtccatgccctgtcccttcctgtccacaagggcctctcaggggacagtggtggggcccatccctgggtgaggctcagtttcctgatttcaagtttccttccgcacagggaagctgggtcctgcccaccaaggtcccagggatcctcctctgaggccccctctctcctttgggtttagtcaacggagagggagatggggagaggactgaaaggtctccccaaaggtacaagctgagagacctggatttgcaatgtaagaacccaggagaaataagtggaactgacggggtctaaaatgtcacggctattctgtaaagcaggtttgtccctgttccatccaagtgtcctgagtgagcgggactctgcttcgagggtgtcaggttgaccctggctctttcccttgtgtggccctgctatctttggtacatgcctcccaaggtggccctggggacagtctccaatccactgagtcatcttcagaagtctgcatgcatctgcagaggggcaggtccttctcagcctggattccactaaacctcttccccggcagagtcaggctcagagcctcctcgtgcagccctggactctgccgggagcaattagtctcagaatctcgatctgagagagaagcgagcgaactggcagctggggccagtctggggtcctaagggtgttggggttccagaccctcacaggacatagaggggcagtggaagtggccctcccaggagaagtcagatcccttgcagggccgcaggaccccaactctgcaagggcaactggttggtcttttaaaaggatcaaaatgtgttgaagaaacgacagtaatgcctagaacaccaacctggcactaaaatgagtgaaacagagttacaaccagggacccgaggaagatccaggatattttgctgagtgaaataggaagatgcaaaagcacacatgtagagaggaatccacaaaaatctcaaaggacacgtactcactccctcctttgaaagcagaatttgaagaagcaaagaggagctgctccctgagcttctcgcatctcccttctcctcccttctcccttctcctctcccttcctctcccctctactcccctctcctggcttctcctctccacttctctcctctttcctcctctctcctctcttcttcccttctctctcttctcatctcctcccttcccttctcgcctcccctcttctctcctctcccctcctcttttctcctctcctcccttcctccctcccctccccactcctaccttcctctcctcctccctccttccctttttgcctcctttcccctcgtctccccttctctcccctcctctcccctcctttcccctcctcctccttctctccccttctctcccttcctcccctcctctcctcttccctcctcccctcttcttccctccactcctcccctcctctccccatcccctctcccccctctcctcttccctcctctcccctcctctcccctcctcccctcttcttccctcctcccctcctcccctcctctctactctcccctctcccctcctcccctcctctcttcccctctcctctcccctcccctctgccctcccctcctctctcctcctccactcctctctcctcttctttcctcccctcctctccacctccttccctctgtcctgtactctgctctctcttcttccatgttgtcttttcttatatgtactttaaatatttttgattttgttaatacaagtactgtgtatgcaattcatacctttttagcagacagctcacatggacccaagttggggttaacatgcagattgtgcaggggttccctgcggatgcacccctgtgtgccctgatgtggacctgctccttcctgcttcctgggctccagacagaaacaccgtacccctgcaccagcctctgcctcagctcttcacagtcagcacaccctccgcttcctgtcagggtgttctctgctgagtctggttatgggatccctttctgtgcagagccatgctcccgtgtcactgtgtgtcaccttcaagctgtccccgtgtgtatgcctgtgtgagaatatgtgtgtgtgggtttgccatcgaaggaaaacctttattttggctgctaacatttggaaacatttagagaacaaacaatatcttttaaaaaacatcaaaggttcaaaaaaacaagacaagaaacaaactgttgtaaaatttcaactcctctaaatttgtcttaaattgaacttagaactaatctaataaaaatagtatgaagtttcaa

SEQ ID NO: 2636 - DNA, 45084 bp, Homo sapiens
aggtgtttggagagcccggactggatgcccactagaatcctgtgctggtttgtagatttccttaagaccttaagacatgctgacatcatggtctcctttctcagattccttctctctttttctctttctcccccactctctctctctgtctctcactttctctcctttcctccctccctccctccctccctccttccctatccctccctcctctgcccaatgtctcccaatctctttcctttctctcttcagttcctccaggtaattcttactcaaacttgtaccaacttgtttttgactgacagtgaacagtgagagagttttcttcattttgaggaaccctaaacacctatctttcccaaggcaacctgtctggactgagcatttctctgacttgacataacttcccatccagccaggagtctgcactcttcagtctttgcaggtaagaggtacacggcgcttatgttaactctggggcatgtggcacgctggaggtatttttgaaaaactttacttctaaaggtaatgaaagcgttgtgattcttttaaagcttatttaaatcatttaagacgcccgtgcttatctgggggaatttacaagtgctgtttgcatgtggaaaacgggattttacttaatgatgggacaaaaaaaagtgttttattcttgctcgtgaaacaatatccagatgtcgtcttgtttgcggtgggtgtacgggggtctagcttgcgggacaagaattactccgacttctctttgcaagggtctgtcagagcaagtttgttgattttcagcgattacatagttctttggctaattctgaagcagttactttcctttgtcaatggggaaatcagtttagattgccgtaaggcgaaacctcgccggaatattttaaaatctgttacctatccttttgagaaaagttatgtaagttttctgtggtaggtgtaaggaatgtaaacgatcctgagtttggaaatattatgaactttgttcatgacccatgattaatatgttttttaatctgtgtataatttcatgagagtttagactatcctcagctaataaatgttatactgggtgaaatttccacattgctcctgtaacgccaacgtttgtctcctctgtacttccgcatttagtcacttgaaggaaataagaatttattgttcaatagacatttcttgacctcataatttcttttaacccacaggttagaaaacttacaacgaatgtagtatttgactgtggaaaactaaagaccaaaaatgtgtaccattaattcaaatgtttagatttatctttttcccctttacctgtaagagggattttgaaaaaaaaaaaatccaagtgattcttaaaattcattttttgcaacctcaagatcacaagcacacactcacactcatgcacaatcaactgttatccccaatcctatcttcttttgtcctcttgtgaatgtttaaacaaatatgaaacaatcggtagtaatagccttaggtgacaaattctctcctatttaaaattgtcctaaaaatcaaaagaaaagtgtcccataaagctataatacatttttaaatatcatcattttgtgaaaactaaatacagtatcagagacacttccagccgattaattaggtaagtaagcacttacctcacacacagcttccccgggcgctgttctttcttcccataccttctagggttttactttttagcagtttttctccttctctgttaatataataagtgaccatccagggaatggcccagaggccacaaggcaagtcttcccaaaatactgaagattagaagagtttaaccaaattcctggtagcagcatgtcagaaacgctcatcaaataacggaacagacctttcttcactgaattaaataaatgtataaatagtctgggggttttacagaaattgccttagttgaactttgtgattctggttgcttaaggaaaacacatttttctaaaacgtcctctctccatgtttccactccttcctcccaccaacagttgtggtcattttacagaaagtcttatttccccaatttcctctcctcacacttctcaccagtgcagacagccagtgttttggggggaaagagagcgagaccccaggctgcacatgccagcaaacctgagaagccaacaaaagcaggtctctgggctctttcccataaggctcagcacaacctcactctgcttctgcatcgaggaaatctcgaaagggctgtgctttcttggggcgtgtgtgtgtgtgtgtgtgcgcgtgtgtgtggtgtgtgcaattatatacctgaataacaatgacatactcgttataagaaaactcaccaatatgtggctttaggcacggaatagagaggcaaagttattcggatttaatcagtacatgtcaaatctttggaatatcctttcctgtgcaatcccctctcatctgtttagagactcaaagcagcccacgaagttttttgcatactttgcctcagagtccaggattgcttatgaaatgtatttgtgtggtggatgcgtcagagtcttagagccaacataagagtccagagactgagctgtaagcatgataaagctgtcaatgactggcccgtgggaatgcttgttgaaggcatatacacctccctaatcattttcttcagtctttaatatgtaagtgatacagctaccgttatttttttccctgcagcaattcaagcattgcaccccggattaaatcatgtatctctaaatatgttgttttaattctttcaagtaaaaataattccacaccgaaaattgtcagaaagccattacatgagttaatattaacttttatgtctgcaaagatgagtttgttgcttattcatgggcaaatacaagaggcaagtcagacagaggttattgtctaccttctctctcttctgtcctttacctttatctcataaaagccacctcaggagtggggcttttggtgcagctgatggtgggataaggccggggaagtctggatctagaacaaagtgaaccaagggtgagccttattctatgcccctcaaggatgcagtgccctggaaggagacaggtctgactgaacacacctggctcaggtaacttcctggtgccagttttgcagacaggtgaaggagcagtgtgacccggtagtagctccagagacaagcaatctaagaagtgctaaatcttccctaaaagaacacaaggagcctgctcctacctttaaaaggagaactaagggcagagagggagagaaactaagttataatttataaataaaggtttataaacatttaggaaatgcaacttctttcttggatcctttatttataagttctgacttagtttctctccctctatgcccgtgattctccatttaagaagttttatttgctaaatattactctgttgaaatgaaagaaaaaaatgagggggtagatatttctgataaaaaggccaggcgagaaagttgaacttgacaggtgtagcctctggaacacgtctctggatgaattcagatgatagtagggggatctccactcatcgtaatgcagctggaatacacatagtgaattctgtcacatgcccagggagaatttcagtcagaaacatctgtgctgttttcacaagggaaaggtcagaactccatgagtagttcatgtgtctgcatttcttttgatgggcattgtgcctcaactagagaagagatcaataagccaatagccgccactatccaatttgaatccagaagttcacacaacctaattccagaatacagtttgtgcttctagatgaaaaattctaaagcacaagcacacaattccagatattttagccactatacaaagatgaatcagggtcacgtgatcatgctcacgtcagaagatgcaggagaaggacaaagttttgcattttggtacaaaacacgcatgtgccagccacccgattcgtttccagtagggagcagttgagtggaaggtcatgtctgcactaccttaggactgaggacctacagagggaacactggaaagaattagcaacagaataagccaggttctgtttgattctgtctctcccaccctgcagctccaattcagagcagtcttaatgtgcagggatccgcatagaaccagccaagcagggcctctcgtagtagcctgaccagaagtcacagaggctgtgtaggccactcattccctcattcagagttcagacatcctgagcctgcccatgtccctgagattacagataacacgaatcctcagagtcaccgctgggccatcaaagaaaaaagagggtgacgcagagagggaacactgcaggggaggaatgcaattcttagggtgctctgaggacccaggtgcctgggtttgggtttcattcacatcctgcttcagtcggagctgccctggtgttgggcggatggctatggaactcatgtgcattttctttagtgtctacactggaggctgatgaagattttatggacccttaagattgcacaatttgggggctttctttagagaaaacaaatgcaaaattaggactgtactattaagtacaaggatttggataggacctgggcaagtgaggaaccctgaagctgaagtttcattaacttcttgataaatccactctgtgtcatacatagtaaagccctgatacttgtctcttgaatgaatggttgaattaacttatgtaaattttagctgctggctgctctctcaataactctgaaaaatgataagcaaaaaatacctatcatgtttatccatatctagtgatcagtgatatatggaaaaccaatcttaatgctatctagaatgtttcttgtttcattggcaccttgccatgaaaggtaggtccttgtactgtagttgaacctttaggtcatatctcagctcaagggtaagatgctatcaaagctgcttttcctatggtagaatatgtgagtactgaaattaactgtgcgctttttccacctgaaaagcccccaacttaaaacctaaagaacgttatgctagttgtgccactagaccctagaatggtattgaatgcatgaataataagcatcttcctgagcagacttgagggcttgccccagtggaatatctgtgtctttggtgagaagccttcctcttttttccttagtttctattaacgctgtttccaattttcaatagcagttaattgtgtcatttcttggtagaaatgctggctaaacccatgcctaccaagccaaataatgttctcactcaatgatgtttacattttcaaatatttgcagattgatatcttgcttcatcttagacctctttgccaaaaaatacaaggtcagctccctgaatcttgctttcttatttcctgagttatccttcatgtctattccaacctttaaaggacaaatttgaaaagtttatcctctgctttgaaagtttatgaaatttgtcatcatttgtactcttcctaccaacgccattctcacatatctgctaggaggtaaagaaaatataatgaatcctggagcacctggctgctgtgactagcatgctctaaatactaagaaataagaaacctgccctgtcttttttatattgtcagaagtttgtggaaagaatttatatatggacagtgagctgtattacatacagacacaaacatacaagtgacaaaagcagtgtgggtgtgtatttagctaggacattaataacaaaactgactgtgtaggtatagagaggctatcccaatgtcaacaacatcagaatacaatggtactgtattttgaacgtcttgtttaatatatttcaaatctataattttgacttacagtcaaaattaaacattaagtgcacacaaaacaattaccctttaaacagtatttttaaaaagtgatgtcatagtgacattgacatctgacatctttttttttttttgagatggagtcttggtctgtcacccaggctggggtgcagtgatgtgatcttggttcactgcaacctccacctcccgggttcaaagattctcctgccttagtctcccaaatagctggaattacaggcacctgccaccacacctgcctaatttttgtattttcagtagagatggggtttcaccatgttggccaggctggtcttgaactcgtgacctcaggtgatcctcccacctcaacctcccaaagtgctgggattacaggcctgagctaccgtgcctggccgacattgatatcttaacgtcactccttaaaacgagttggatataatgtcaaacgacttgattcttgtcaacaggaatgctgtgataatctgattacggaagactcagggtcttggttcctaggccctagggacagaagaaggctagcttctcccagacaggccaaagctgctttgaggagggaaggggaggtgaagtctccactccattgccagcaggacacacctgcctaggaactgggggagaactctcagaggctgaccctatacttcctgtctctggagtcaggggacaggggtgattctgctggtcagaaggcaggagggagtgtcctgaaacacaattgaatttgacagcaaagcactgtctatcctgggaagttctgctggtgagcggagtcctgtgagggtcctggtaaccctatccctgcaagaaataagaaggtctgcactcaaataggttcagaaaacctttcctagtttaggcccctcttgaatcttcacagcaatcattaacattttaaaaaccccaagaagttctgcagcaaagacgttctttaactttgaatccaagttgtacatccattttggaccgcagaactgtccaccacctcctccctgaccacaactatgattccctcctctgactaacgtttcacacaaccccacgggggatgctttggccaactgtgatgggtgtggagtggcaaggcatcgtgcgatccaaagaacatgtgtgatgtccaggctccatttaggtgtaagttgtactactggggcctgactacctctgcatgtgactggccagccttcgggattgcgaagtggctgcttacagtcagccccaaagaatttttttttactttctttctgtttctttatgtccaccttattcctaaaagaatttaagtgaatttacaaagatacatacacacacacacacacaccatgaaataaaagaggaggaaaataagagtaaatgtcaaaaaggccatttgattaaatcatttacttacataaatttgaactatttttaaaaatcacagttgagtgcacacagatccacagtgccagaatcttacttttgagctcaacattaaatatagatcttaactacatctgaacttaacttagcttcctatttgaacctgggaatcaactgggcactcactgaatgtagttttacacgcactgtattttacaattcttttgaaagacaatgtccattttcctctgtggatcttttaaattttatttcaccttttacacccctttatgtataatttgtttatactgagattgtaaactttcttcattggcttagactcaggtctggcactagcctaagggactaatctctggtccatcaggcctgggctgggaaccctctgtgggattccctccccattcccggagatagctggttcgccctgcttggccccactttacaatggcctgcttacttgtcccttttccctacagggctgcaaactctttgacaatggagattttatgtagttatttctttgtgctttcagggcatggcccaaggtattcttcaagcaatatgtattgaatccacaggcactgacatgaaaggcataatttttgctataattacatctttactttcaccatgaacttacatctacctcatcctgcaaacgcacagcagagacctttttatctgaagtcttttgaaaatatgtgtatgtgaaaatggctaactggtgtgttctctcccttggtgaatattacaaagtgatagattggctgctagaattgcgtaagtggggttattaaggagggagacatcttattaaggagtgacaagaaacagggaaccatgtgcttaagatatagaagttgtgtaaacccaacagaggagaaatagaaaacatgcaggttattttggaaagaagaaaatgaagacacttgaaataaaacagaaaagtaaatacggagccagcagggttcagcatgggagtgtgggctggaagtctgattctgaggaagaaaacaaggggaaaaaataaaagaaagaatatactgcaatcccaggctagaaaggggtgatttgatccatggagcagcaaatgcagaaaacaacaaaattagcatcatttcagtctccttcaaacgctatgtctagatctggcttgtgttagcatacctgtggcaataaaggtatttggctctgaatgtgttttaaattttaaattgaagagaattttctaacatttacccattttaaagatgaaatattataggactaaaacttgtaagggccacttttctgtgattacaatcaagcgaatttcattgcagctgggagcagcctatgccagtatatggcatttcagagtctagggctgcataaggatatgtacatttaaacatgaattgtataattatggatattaacatgtctagtccaatatcctgggaatgttccctaaatgatactttctgcacagcactttgcttagttttcagtatctgaagaaatggtctgacttgctagccctgtggttggtagaaatgtatatttgatgggtttttaaatcaactctcactcagattttgaatagtcaggctttaaccctcagtgatcttcaccaagtatattcttgccaagggcttactctgcaggaggctgggtggtccgtcttatgtcgatttagaagatataagtgacatcaaggactcaaggagcctccaggctgctgctggacagaggtgtggataggaagacatggaggtagagaaacagtaaagaaaaacacccaaagcacaagaaaggctgcagtgtccagcagaatgtgatgacattgacatgagaggccctgacaaagttccagggaaagtcagagagggaaagaccagatccctttgggatgactgtaagaggcactgggacatttgagatgtgccttgcagaacaagacgacttccagggtcaggacggggagaagccttcagagcaggaggagttaccatgcaccagcaggagggtgcgggaggtcggcagtgtgcacaggggctgagcttactgcagggaaagaatgggagagtgagggccacagtcaggacaaagctggcagccaacagtgctgagcactcctgaaaggccaggcagggctctaagtatttctttttgtttgtttgtttgtttattatactttaagttctgggatacatgtgcagaatgtggaggtttgtcacataggtatacacgcgccatggtgatttgctgcacccatcaacccgtcatctacattaggtatttctcctaatgctctccctcctctagcttcccaccctgctgacagtacccagtgtgtgatgttcccctccctatgcccatgtattctcattgttcaattcccacttatgaatgagaatatgcggtgtttggttttctgttcttgtgttagtttgctgagaatgatggtttccagcttcatccatgtccctgcaaaggacatgaacttattttttttatggctgcatagtattccatggtgtatatgtgccacattttgtttatccagtctatcattgatgggcattagggttgattccagggcatttgtgttggttccaagtcgttgctattgtgaacagtgctgcaataagcatatgtgtgcatgtgtctttatagtagagtgatttataatcctttgggtatatacccagtaatgggattgctgggtcaaatggtatttctggttctagatccttccatggctctaagtatttcttaatcctcacacaggcaggctttcttgctaacctctttagagatgaggaaagcagggtgcagaggttaagtaacacgctgaggacacaggcttcagagaggggtgaagctggcctttgaagctaggttgtccatctctagaagccacacccttaagcctctgctgcaggaggtgggagttaaacataggcaatgagaagtcattgaatattttggttttctgggtcctgagctgcactttagaaataccagtctggcagtgatgatcaagtgactaattcaaagggtattttgagagactgagtgaaaggaatgaagacctggaccagcatggtggctgtgggaaggggcaggagagacaccggtgcaagggagattcagcaggtggaatctggggcttgcactgattggatacaggagtacagttgcttaaagagggagaggtgagagaatgaggacgccattgttaggaaacaaaaatcaggagatgtagctggatttagggagaataatatgccttcagttttggatgagtcagttctggactgctctcattccaggagatgttggaaacagagactggatccctgaggagatgctgttagtgagcattgattaacaccatgggactctgaataggcagtagggtaactcagaggatgccaagagagaatagaaagatataataaaggaggatgagcacaagaccttggggaatataattacaaaggatggggaagaagaaaaacccaccacgctgcaggagagtgaactctcagagaggcagatagatgagcaatgagtctgctgacccactggtaaccaacagtaggaactttctgaggaagacacagttaatggcgccacccttgactcatatatcagagaagaggagatggagggagttgaagggaagaaacagtggaataggaaggcttggtagcaccttgccaactcagttcagatgaaaagcctgagagaaactgagagattatcatttggctggcagagcagagttctcagggtcctggaagctggctgtcttcaagcctattaatggttaatgtttctcatgctcttttttgctaaatttgacaaacctattccccttcctcctcaaagtcaactgagttattcactcagttaaatctatcatgacttaaaaagtatatgcttagcttggagagggggttacatctgttcttgtagtcacataattactggagacatgaaggaagattccagcaactcaggcgccttctgaacaggttgaatacctggtttttatgagcaacccgcttcagttttctgagaagctctgagtaactacaactaaacaagtctattcttgaatatgtttataataaaaaaggaaagataatgcagttatttgctaattgctgcaatgattaaagcaagatgtttcaagtttatcctttcataagaccagcagccttttgaacacaaacaggatctgacaaagatagtaataatgaaagcgggagaacaaggaaacaatgccagttttcttcagaacaatcggttgccactgacttctaacctacctacagtttcaagtttctttggctgggactatattctggtttttcagtgctgtactgtgattaagccaaacttcagcaaaaaaggaagtgctgcattgtagcagtattgaaagttatgtaggtggattttttaaaaaaaatattacagcctaaattttcttagcaaaagtcaaatgagtaacaacacacagtttggaaacatttggagaggagaaaacaaatatctgacaagagtacttaaaatctgaaaaaaaaaaaaaaaaaaaaaaaaaaagaaagtgggaggagagtgagaaaaagcccctgacaggtaatggtggaaacctgacaaatggaaggtcattctaatgagagaggcggcctggtctcatggaaagagactttggcctttggaatctgaccttcctggatgtgaattccaggtgtgcagactcctggcagcaatactcttgggaaaggtgcactaatgttctgagcttcaatttcttagtacattatggggcatatgggaaagagacagaggtgggctacttctctctccactccaggatgccaccctcccactgttccccaccttccttcttccccaggaccaggctgagctcaaggcttgtccctaaggcagctggtgaaggaaaggttcgacttggtggtagaagccctggactggagtccccacctatgggctgagggatcctccacaagtgattcaacttcttagtttctcacctacaaaaggcagggaaattcctgccacaggacaacaaggaagttaaatgacatgattttttgtgaaagtgttgtggaaagcacttctgtcttctatcttatgaatcagtagggaatgagcattctcaaaatgaccagaatgattcctaatttcctttctaaggacctgattcccttttcatacgttctttttgttctaaaaacaaaacaaaacaaaacttactttgtaaagaaagcctgaattccagagccagagtctgtccgttaaaaactttcaagctttttttttaaacttataaaaggcgttataccctatagccactcaaacttgtataaacaagagttgcaatgtgaaaaaactcacttgctgggtttgcctctatgaacaactattgttgtcaatgcaaattgaatccgaaattacccttgtcattgtttttttctggggttgcttctttcatttctgttaaaaatacacagaaacattaaaaaagtaactatctcctctgttttataaggagaagaagggataaagaaaaagaaaatcaacttggcatgcaagtgagccttgctctggaatttgggtgggtctaggaaaaagcaccgacctcagtggaaaacatatatgggtgtgtgggaaatccctgtaaactataaattgactacacagtgcttaagctggtgtggagagaaaccacaatactctctgaaaccagagaggaggggacagagagcaagttttgcacgaggagagcacaaagtgtccctgggagacagagctgctggtaattcttagcaggcttaactggatctattgaaagtgaccactgtaaaacaccactgttgcaccctggggttctctgtgggatgcccctacttgtatcatgcaggaaccctatggcctgactctgcttcacccacacttcttcccaccgctccccagcaaggccccccgccctgttcaattgctcctgtatgcttccccacttcactgccattgcctttgcagctccaattcctggaaagcattctttcccttttctattagaatctcattatgtagcttcgaagcccttcaaggcctgtcaagactcagctttcccttcccgatggggccttacctcttctacactttctaaatgttatcttctccaggctgaacaaaacctagtgtgtctctttgctactaaggactaatcagatgctgtgtcctgattcattcggtgttggtgtatcccatatctccaatcagattacgagcccctggagggctgacagcacgttggacttggctgagctagaatcagctcccttttgcaccctgagctgagtgcatgcagctcagcatttgtaatcctagcctaatgcaatgtgaaatttattatctctctttttacaaatgaggaaactgaagatcagggagacagtgtgacttgtccaaagtcactagcccagttgcctttcagaaggcatctcactccatcttcaggatgaccccaggggctaggctttcacactttaactcctcctagaaggtcataacctgaagatctgagatttgaacccaagtctgtctggctcctaccctgtacctttcccactatagcatattgcctccctatcaccaaaatgcccaacacgaagttgaacatggcataatatcaaatgaacttgtgatcatcccgttttgtcaaaactaagagaacataaaaaaaaatcagcaaatttgaccagagcagtgtatttatggcaagaccaaggcaaaacttgattctgcattctttgcattatagtaacagactgaaaaggttcataagtgtattcatatttaagggagtgtgtaactgttctacctgggtcaatgtagaattccctatacgttgcatgcatcatcaggaatttcatatgcagcagataggcatacagcctggtttctccaacagccaaaggcatttctgagtggcaacaacactgatctggtgaagctgagtccatctggacattggggagccccaggccagcagggtttctgctaagtggacctttccaaatcctctcagggacaaaacctggttgggcatcttcaagaaaagatgctcttgtaaagttggtgtagctgcttaaataagccccgaatagagtctagtccgtctctctgtgcttttctttaaatttcccttcatagaaagctaaaacttaaagaggtttcagagaagctagtctgaccccatctcccagtatcattgagaaaactgaagctcggaggggctgggtcatttgccggaggttttgcaggacacagaagagcttgttctcctaatgtggcctagaactcttcaccaggcctcctcctatcccaggtggaaactaaagaggaaaagatgaagccaaactcaggcggaagcaacataattaaactggtttatcgtttggcaacagagatcagaggagtgagtggaaagtgaaaatcagtgaaacacttgcagtttaaaagaggcatgcgattcctgcttttcctaagcagttgaaatgtgtttatatgtctttcctggagctctctcattgctaatgtggtcctataaggggaagtcctggagactgagctgggtgtatttgagtattcttctcaatggaaggcaatgagcttgtgtgctacactgcttaggccacacgatcccccaagcctgggctgccagacgtcgccatcattgttccatgcagatcatgcccatcctgtgcagaaggtcactataggaacacatggcacagggaagaaaacgcccatagaaattcacatggtgcttgtctaaaccgaaggcaggtgagatccacccactgtcatgggaagctgctagcatgctcccatttgtttataataatttctccaccgttagaggctgctttaaaaagaaacggccaaaacctgcgatccggtgccacaattgagacagaaagcatgggaccatgacagttttaagaattactaaagtatgaggcttgaccagatcatttttccaaggatccagagccctttagagagaattcaagagggagaatttctggtgacttctaccacctctgaagaattaaaaaacttacttgtgctgctttccaggcctctgtggtagttaattctgcttggcagtttttgttgtcaaatagcttttaagaaatctggagctatctcagatataaataccttaatgatgccagaggactgtctttcacccataaaaactgaagccatgtgccagaagccctcgtggctcaagggctctgtccttggacacggatgagggcagctgggcggtgggaccgaggctctgcctgaatgctcagcttctgcaagctggggtggagagtgtgttcctgcctaccggctcagccagcacaggagcacgtagcctgcaggtgtgggttgtacacaggcttccccctgctgagtcagttccccagatctcttcatcacttccccagatctctgggatcttcagctgagattgggccccagcacctggactcaaggtaaggccccttaggatgcttgtagctgatcaatcagggtagtgcaaaggaagaggggaaaaagccacccagaccttaaaggagatttctggaagatccaatcaaagtgattcaccttaacctcaggcatgacttttccccattatctgctgtttttaatttcaagtagtataaatcttactgatctgaagaagacttctgcttctgaaactaccagcgcttaacaatgattgagccctactctatgagattgcaaataaaaatatattaaccttggcaggaaatcaactgattaatacttataccctacactctaaagactggaacctcaatttatctgcataaacagaggctttgggtataaaagtaaaatgtagttggttatgccaaagactgctttcaatagtaatgcaccaaacatgcttttgaaaatagcaataaactattcatttaggttagatatacaaataagtaactttcagagttagcactaagttttaagcctcaaagactttgatttcagtgacaagatgtgtaaatgcagcggttagaaaaagtacacatactgaggtttctttcaagattatatatagtattattcaaaagtcttattgtatatgaaaagtgacaagatttttgcaatatgaaacaacagtagctagctaatactctagttacctttacagattgtctagttggtcacattataccttaatttttcaggatccaaccaaggcctggttaactcttactggcaatgtttgaaagggatgaaagaggtcctatgcatattactctaaattaatcttagtgcaggaagacaagtcatatttgaataactttattttgtatccctagctactgtcatcctagtatttgaaaagctccttttctcccaatgttcagaaagtcattttccaaacttgcaaatattaaaacctattcatgtctaatacttttctacttggtctatttccatgtcctgtcaatgacctatcaattaccctattcaattacccatgtcacttgagatttctcccaccagaatttaggttgcatattttcacagggcaatttattttaaaatcagaatggtccataaaactaatagctttgtgtgcacagacctaaaagatttgtagtagctctgcagctgcatttttgaacatcaatagttaaacgatcaacataaatgttaaagaagtaaattaactttcagaatttcacgtgtgctctagcattcaccattgaccatgctggaagaagactttgaggtcatttcatccaaccctctcattttacagatgaggaaaacaggactaattgatagctagcaatactaaattatagctcttctaaaactagacagcagcgtcagtaggcttcttcatgtgctcaattactgtatggattccacgagttgatgagcgtgctgtgaccttgagcatttacattctgtggttttcaaatgtttatgtttctaatgtggtatttgtaaacctgggccccagtaacctttaccactgaggctttgccaatcccaactctgggcagcccacctcttccatatgcagcagtgcttgcaggctgttccgcctgggcaaagtcatgttaggtgtaagcaaagacgtgaactagtgttcatgcttgaaaacctcacagagacctgcctgctggctgaatcctttcttcatctcttgttgcctctcctacatgtgactcaaaagctagccaagtttgttccacatccttcagcttgttcctcttacaccaaagtgccataccatcatcccctttagtaagatcacacttctccaatttctgtcctcctctactcctcaataaacaggaagatgctgtctgtggaaaatgcacgtggagctcttgcacacgttttctataacttgtcttccttccacttccccacaactagaatataagcctcatgagagcaaatgccttgtctggactgttatctcccctgtgtctagtatagtcaaaaatagtaggtgatgggtaaatacatgtgcaataaatatatcctttcatctttccttcctatcttagggaaacaaatgtccctttcttttctgtcttacctccctaataacatcagtacttctttgtccctcctccaatattgacctctgaatcacgtcctccttcttgaaatcttgccttcttaattgtctgcttttattaatttacataggtgtccagccatctggctggcctttctccagttcttttgctggaaaatcctctcctcttctctttaatacaggcagcctctaagattgccccttcagttgctttcttcccttggtatttttcttttttttgcagttctcattgactcatatctggtcaacttttacctctaggtacaatgattcttcaatttccacctccagccccaaatttaattcctagatatggacatgcttggagccaacaccaccatgtcacctcaatacactctgcttttcatccaaatcttcctttccatccaggcagcaaactccagagtcctttccactcctgttcaacctttctacttcacatatgacaggtgtgtgaattttacctggtggcaaaccaacgtggtgattctcttgaattcatgtattacttagacaaattcaacagcctcctaaatgatctccttctagctgctctcctccctctccatctgtcttgctagatgagcctggcttcttttttcctgcagaaagatcaaacttttcagtttaacccgcatcaccttttaaaattcattgccagtgtagttcccaatatggcctcatactaacttcagataccccagtgtatctgaagaaagtaatcccagctacttgggaggctgaggcatgagaattgcttgaaccggggaggcagaggttgcagtgagccaagatcactccactgcactccagcctgggcgacagaccgaaactccgtcaaaaaaaaaaaaaaaaaaaaaagcaaaaagcaaatgggaaacttttttttgaaaagatcagaggctccctttttaaaagagcagagctcaggctcttactcacatccctgtgccccaccaaaatattctgattttattgtcctgtgtcagagccaaggcattagttcattttaaaatccccctaggtgaatctcataggcagccatggttgaaagtcgctgataattgataaaccctatggcccaatcaattgggagtacttgaaacatactttgccaccccatagttttgcctgggcaattccccttgtctgtaatcttctttctcctatttttttttcctacagaaaacacatgataacttctttgatttttccagttagaaggaatcagtcctcctcctggaaatccttaataccttttaatatatcatattcattcatgtgatctaggcagaccttgtgttagatatggacaaaatggagagaaataagacaaggtccttgtctttaagcagcttacagtcttgccagctcactggttacacatgaactagtgagtatcaacttttatgatagaagtgtccatgggatactgttaaggcatgaaggagcctattctgcttggcatgataacaatttatgtatatgtcatctcttatatcaaatggtatactttcgagggctaagatcatgcatctctcacctttacgtatttcaaagaccacagtagtataaaatgtttgctgaataaatgagcaaatgaatgatgttttggtaattaggagtcactggggaataatggcagctcttaggaaatggtaccatagttccattcttggggtagggctgggcgtgtccccatggagttcacagaactatgtcataatttcagtactaaattatgtgtgttttacagtttctctcaatcacccattctatgttttatttaaaatggtaataggaatagcatgttagaaactgggtcctgtactcattaacaaaaagaagggagcaacagacattggggtctacttgagggtggagggtgagaggaaggagaagcagaaaagagaactattgggcactgggcttaatacctgggtgttgaaataacctttacaactaacccccatgacacaagtttatcaatgtgacaaaccttcataccctttttttggtaccccgaacctaaaataaaagtttaaaaaattatattttagaatatattcaaaaagtaggatattatttctcaaagaaaacatctgaattcatactttaaaaatattttttaaaacttgaagtttgatcaaggcatttacatcctaggagacaaaagcaatcatttcagtatgcattctagatttatcaactgcatacatattttaggaagattttaagatatttcaatataatatctaaaaatgaccacttaattttagtaaaaagagactcccaccttctggtaattgacaattactatggtctgagagtgtttagattaaaaaattgtgtgtgtgtgtgtgtgtgtaaaattatcacaggaaaatcaatacatcaatagtagcaccaaaaaagaaaaaaaaaaggaaagaaactaggtcctatttttcatgactaagaagttgacaatggtctttccaaattaagactcggcatctttgatttttgtaaacatatcctggagatcgaatgtgaacatttgatggctgatgggaagaattgaggaggattaggggagcacttgactttgccatgattctcaagttaaatccttggacctcttaaagatgttgttgatgaagctgctaaaatggtcaccagatgaatataaacaagtaggacccgcagtaatttccaggctaattttgtgcacgtgcgtttaggggcgagtcaaattaaatgaatgaggagctgatgttcatgtgaaagtaattactctcctccagtagaaatcctaatcctacaagtaactgcagaaataattaatcataactaagaagcaaaccactctcagggagaaaagctgtatctgaacttccacgtgctcttggaggatacgggtgattcacggcataagagtcatctaccaagtcatctgcaagagcgagtgcagcttccaagagggtctgagtcagaacagataaaaggaagttcttcttaactcagaagatttcaacactggggaagctcatttcccacagagatagaaaaatgtgcactataaatcactctcaaaaagcaatttagacaactacacaggtaatgataaatgcatggagagcactcacatgttttgggttgtgtttttgaccttcattcattctttatagattattaatccacggattaagtcattgactcatttatagtcatgagtcattaaaacttttctggagcatctaccacatgccagcaactgtgctacttagggtacaaaggtggacatggcccaacccctgccctcaaagaacttctagggaacactgactttgcaggcatgattccgtctgcatcacgcatcagtaaacagctatgtgtactgtagggtattgagacacaatgacgttccctctgctcagctcatcaccacaaccaatgtgtaggagcttgctttttgagacccagcggtgctttctataactggaagattccaagtttcctttgcttccatttatgcattcagcagacattaaggccctgctagaacctaggcattggcatgtacaagatgagatatggcagcttgcattccagtggaaggtggtggggtgtgatggatgaagagctggcttttgagtcagactacaatcttaaacattgtcgccactactagctagttgtgtgaccctaggcaaatgctttaacttatctagcctccatttacttatttttaccagcattactctgaagtgtggagttatacatacatgagctgccgacacagtactagttacatattcattctcaactagtggcagttgttggttggatcattattataattaaatatacacaagcaaaacagatatctctagtacactgagataaatattctgggagacagaagcataggcaatcatgtagagaaagccccaaacccatgggaacaggtggagaaagcacctacctagaaagggtaacaccccaaaggatagacatgagaacgctggccaagacaggaggtgggctttcgggcagatggcatggcatcaagtcaatcaatagaggactaatccatctgggcaactgcaagtcattctgcatgacctgaccaggtaacaacctaaggagtggctggcactaaggcaggtggggccagtttctgaagggtcagtttcaggagctgaggctttggtttgtagacaatggggccactaagctgggcggcagagtgctttagggacaccactgaggagggactatgaaggatgctatagagagaggacaacttgagatggggacctcaattatgagcctgtgctgtcatgcaagaaataaagtatgtggatctaaaccaaggcagtgtcacccaagaaagaaaatgtgtggatctaaaccaacgcagtgacagtgggaagggagaaaatggacagcttcaagggatgttggggtagactcggggtgctgagtatttttcagtgcctgagggtctacgggaggaagggagttgccctgggtaatggataatgaagctaggctgggtctaatttggggtgtttgtgggcaatcaaagggaggaaccacacacagttgactgttgttctggcagtcttgcaagagcaatctggaacacaaaaagtctaggcttcatgaactacaaaggtaacatctgaaaccatgggagtagatgcaggagtgtgtctttagtgaaaataaaatagttggagcatggagccttggagaaaatgccacttcaagattggcagaagaggaagaacctacagatggaactgagaaggcatcagaaaagtagaggtcaagttgagagaagagagtagcagcagactgaaatgctatggaaatatcaaggaagataaggaatgaaatgtatttgccagctgagttgtaagtaactctgaccaagtggagtggtgagctgagaggttactctcttggttgaagagtaatcacccagccctcaaggaagtggaagcaaagtatcgcttctgtcctttttaaagctcttctccatatcattgactctgctccccaaagcttggcttttagtgaaagccattctatttagacaaactcattgtctctcctctcaaccccaagacaagcattttgatctctttaactccatgggttttattaccaatgaatgaaataggacatggcacacagagcagacagaaggccattgccaaggtctttcaactggggtcccactctcaattttacttcctgaaagttcaatgtcttggctgaaaacagggctgaagatagatccaaggaagaccactgggaattggccaactaggtttaaactggggaacaactcccctcaagtggcaattttaagggtcttcatcctgcctcattggctttaatccctcttgaacatgtcaaagtggttggaagactgagtcctggtgggccacattgtgtttctgtggactgcggactagtttcagaggaagcacctgtctaacttaaccagggatcacttaggatgaacaccagttacacagtatagaagacataaatatttgaaattttatttgcagccactgttgcacagtgcaagctgtctcagaaattaaggcatatatatagttcaaatgggaccaaagtagtcttttggaagtcataatagggcacacatacatgaattgttgagcagaccttgtaaattaagagattcattgtattcaggcaatagtgtgtgggtgtgtgttcgctttctttgggaaaacagcatttgtaagccactcactcccaacatcaggggcacgtcagggtgagggtatatagaggtagctgttattagtgagaatataagcgacgcctgacttagcactctgttactgttagcactaccgaatctttgatgactaggtgtggtcaaaatcttggtttccagctatgtttcccataaatgaagtttccagatataagccaaatgcttaaacaaaattgctgactacaggatcattttgtaatactgtatgggtgatttataagctgtgtttttttaaagaatgaagtcatctagtggctttgaactttctccccataggtgaagttataagtccagcaagctcctcagtggctcctttctcaacagtcatgtgagagaagccagcctcaattaagccccacggcattcactgatggaataaattaccttctattgtatatgtctagagtgatgcttgctataaccatccatggaagaaatgagaacacagtcactcaaaccattttctgggttcagtaccgtgttgtccagatgaggaacagtggctgcaaaaggccgtttgctatgcagagtgtgagctttcacctccagcctcagcctcgcctgggagctggttagaaatgcaaattctcagacctactgcagaccttttgaataataatttgcatttaaatgagccctcagggaattcgtatgcaagtttaatcagtattggtgtgaagcaatggattcaaaaattatagcctctcgcagcacacacaaggatacttagggacatacatgcacaatatatacatttttcgtcttgctctaacaaattacatatattttatttatttttttcaacttttattataggtatggggtacatgtgcaggtttattaaacaagaatattgcatgatgccgaggtttggtgtataaatcctgtcgtgcaggtagtgagcacagtacctgacaggtagtttttaaaaccaccccacagccctctagtagtctgcagtgtctattgttcccatatttatctccatgtgtgctcagtgtttagctccttctattataagtgagaacatatggtatttggttttctgttcctgcattaatttgcttaggataatggtctccagctccatccatgttgctgcaaagaacatgatttaattcttttttatggctgcatagtattctgcggtatatttgtacaaaattttctttatccattctacatttatgggcacctggcttgatgccatgtatttgctctagtgaatagtgcagaggtgaacatacaaatgcatgtgtcttttggtagaatgatatagtttcctttgggaatacacccagtaatgggattgctgggtcaaatgacagctctgttttaagttcttttagaaatctccagactgctttccacagtggctggactaatttacatttccatcaatagtgtagaaactttccctttctttgcagccttggccagcaactattttttgactttttagtaatagccattctgactggtgtgagatgataactcttcgtggttttgatatgcatttctctagtgattagtgatgctgagcattttttcaagtttgttgactgtttgtatatcttcttttgagaagtgtcggttcatttcctttgcccattttttttaaatggagcaatatgttttttgcttgttgatttattcaagttcaccatggattcattttaaaatatgtataagatataaacacttaaaaggataaagtggaagctacaattgaatacttctatcattttgtcactgtccctgcttgggttactggtgtaccccacattggagacatctggtgtaaagaagcaaacagagccgaaaggaatcttagaactctttgtctatgatggtcagtgtactggggaacatgaaatacacagaggaagtaatttgttggatgaaattgaatatacttatgtttgcccatagtttttatcggttttgtcattttgagagatgtacaactaattttctcttcaagatagaacattgtggcatattctttgtgctacgaatcagaataggaagacgaaatctttatttctaattgaattgttcaaatcagtgaaatattcttcacccgaacaatgtgcctagctgtggactggattcctctctgggattcctctctgacctagaacgttgggcatcataaccttaggcaagtgacattcttactaaatcggacgctgagtccccttgaatggcatctctgcccaccgtgtgcctcccttaaacattaagttcctaccacatgccaggccttgtgtttgccactcaggatgaactactgtgcccagtctatggggaaagctaaactccaagactgatcattacagcagcacagtaagtattatcatgaggtgtggacaatgagaaggcagaagagaggaacaaggtgaacgctacctgcatgctggaggagatgacatttgagcggggcctcgagggatgcgtaggagtttaccaggcatagagcaaagaagaaatatggaataaaggggtcagcctaagcaaaggtatagggcaggatatctgctttatcagcagtatctctgggtgaagtgcaaactcttctaattcagtcaatgaaatgaagccttaagatgactgaaaactaggttcttggatttgtgcaatagatatttggaaatatctctgagagtaaatgatttcataatgtttggccacaacactgtgtggaaagtttctttgtgtaatataatacagaaagtacttctcatttacagtaaaatctggaatacttggaaatggtctgtgctagggaaactgaattttcagattaactgcataaaaatggaaaatctggttgaaaaaccttcctaattttgttttcctttagagagataactgctgttaatattttagaggtgttttattttgatcttacctagagagagaaacagagagattaccctgcatatttagctgtatcaattgccttttaaaaaacatatttagcattttttcatgatttttaaacactgcataatatttcagcctatgagtgttttataaatttaaaaccattcctatattgttggtgactcagattgcttctaatgttttaatatcataataaatatagagaacactcttgtacattatcctatcatacatttcctattaagtcttaaaagtagacttactgactcaagcagtctaacataaatagtttaaaactttgagtatacattgtcaaattactgcctccctcaaaaaagttatgctagattactctatcggacaccatgcaggaagctcttcatttctgcaaactcgtcaatgtagaatgttcacatgtcttttaaaattttcggtaatttgataagtgaaaagtgaattcctggtgcctttgtgtttcttggactgatggtccctcctcagtctcctttgcctgtatctctgactctgcctggtcttaaggctactcaggctcagtctgggttgctgcttccacactactgtctaagggggaagctcctgcactttcatggctcaaattccactcgttggcttatgtgctaaaggcatccctcctgtccaggtgtctctgttgaaggccaggcccatctgcacagaccctagtgcttacttctctttaggtgtctccaggcagcctccagtgcacaccttcaaacctgcaccccagaggtgagatcctccttctgcatcgggattctgcacaagcgtgagctccatgctggtataacacccaaacattcaatctgggtgtcccataacatgtgcataatgttaaaattacagaggaagatccagtgtcctctgaatcagtaagatagcctccgcccaccccaacacacctcatttccatgccaggaagcctggagtcatcggtgagacttcctcttctctctgccttgtcttcttaacatccacctgttggagacgcctgttgactctgtctgggacctgtcactcagagctcctggctagtagctctcaagctacaaacaccgcccttgtccatgcatcagtaatttcaactcagattactgaaagtgccgattaaacagactctcagcatctatgtttgactctttccaatacattccctatgctgcgtttaacatgatcactttcaaaagcaagtttgatcctttctcttccttgaataaaaccccaagatactccttgtgctccaaggatgggggtgacggtcctcaaggagcccacaaagccacatgcaggggcatggcatggctctgcccttgctcctacctgacactgcttccctctcgcctactcaatatcctcctcgtttcctggaaggtgccaagctccatgctccaactccagactaggacatgttatataccccatgtgctagtctctcatctatccttgactttctccccagttcttcccacaaatgtctttaaatcactcatctaatgatgtatttaatgcctcttttccctgttttcttgcaaactacccaagagcaaaaaccaagtcactcttaatgcttcatcagcagcatcctgtgccatgcttagcacatagttggtgctcaataaattcttgccacacaaaccaataaataaatgttaaagtgttgaaatgtcttttcaccttttcaacattttttgaattgcgtttctacacacgttgcccacttacgagaatgaaggctcttgttgatttgtgaaaactttatatgaaccctctgctgttcatccgtggtaaatgtgattccttttgataagtcgtattttatgttttatttgtcgtatgcatatgacaataacagttaacacttgtgtaatgattaatactaatcattatactaatcatacgagcaggcagagttttatggtgctttatatgtttttatttcacgtgaccctatgaggcatagaaatgatcatcatcgccattctgcatatgaggaaaccgagtctcaaaggggttaagaaagttgtccaaagtcacacagctggtgttaacagaagcagggtcctgtgctcttaatctttacgctatactgcctctgaagaattgtttaattttttttaagtacagaagagataatgttcaacctgacttttgaaggacaggtgggagttaaccaagaaagggagaaaatgaagaaccttcaggaaggaattcatgtgccagatgtgggctgagagggcacccagctgctcaggaaggggcaagtatatacccaggctctgttctgaggtgaataaagccagagagggagcgagagccagggcttaagggtctttttggttttccaagttgttcaggatttgtcttgtcagcagtgggagataccggaggatttatgaaagggagtattgtctcaattagtactctagatgagtaagctttgtctttcctggtaagaattatcttgaaaccatggcaatataaagttgcatgtgactgagtggtatattaactgtaaaaatccaccttcctggctgggcgcggtggttcatgcctgtaatcccagcactttgggaggccgaggcgggcggatcacgaggtcaggagattgagaccatcctggctaacacggtgaaacctcgtctctactaaaaatacaaaatattagctgggcgtggtggcgggtgcctgtagtcccagctacttgggaggctgaggcagaagaatggcatgaacctgggaggcggagcttgtagtgagctgagatcatgccactgcactccagcccaggtgacagagcgagactccgtctcaaacaaaaaaacaaaaacaaaaacaaacaaacaaacaaaaatccaccttcctacttccgagaagtgctacagtaaggctatgaagaccaagcattatgtatgtatctgagctgttttctgttatttccccctctgtttttatgtcagaagaaactgtaccattacttctagagtagaagatgttggaatgtctcctcattggtcttactgttccaatcacgtgagcaccaatgtaatgttcattactaacattagtgcctgcaagaatatcctactggaaagggaattagctgtgattttgttaagtgtccagccaattttcataaaagacacagtatctgagatggctgttaaacatgtcaagagattgtgtacgaggggaataaatcaaggaagactctataggttggtctgattctgtgatattaccagaattactggtaatatctacagcatttagaaacttcatccacagtcagatttaatcccagggctatgaagcctggagaatatatgggtagaactcaggagaatccacgatctcacatgaggagaaaagaacagcagtttattttagatggcctctaactaaaatttgtattgagtgtgtgcagcaaaccacagatgtactagctgcaactgtgactttgtcatagtggaaatcacagacatttcaatatcacattccagtcatttcagagaccttgaaataacattgctgctcaccacaccttcaaaacattagctctgatttaatgcttggaaaagtataattttgttttttcagtactgtaataggtgcattttaatatcattggtgtcttctgtaatctttgtgactttacttttatctgtttaaacactttattctgagaaggcaggcatgtgtctcactagtccaccaaaaaagaccataacataaaatgttaagagcccctgagctaatatcttaaaaatgagacaaacttcttagcttttctgacacctctggtaagccatgcatgaaaaggctgcacccccatcccgcagtggttagatttgttttcagagtttttagtactgggaaaatctggattgttttttttcttctaagaaggatggctttacgttaaaccctgtctttaagtttcttggccttaggaatgactcttgagcataagtttgcttttccctagggatgccagatttagcagatttagcaaatacaaatgtaaggccactctgtactatgcaaatctatagatacatatatgtaaatagtacatatgtatctctgaatttcaaataaacaatgaataattttagtataagcatatagcaaatatagcatgtgacaggcttatactaaattatttgctgtccatctgaaattcaaattcaactgggcatcttgtattttatctggcaactctaaaaacaccaaatttgggccaatagtcctccggctaattaactacagatggttagaatgtgttttcttacactgtacagtgatggaaattagttaactgccaaatgtcttaatttttgattgaatgtgaagatatttttaagtttgaaattttgtattatcattcagtgatcacagagtctgctttcaactttgggacaagcaaacaactgagaaatactaccagtctttaaagcaaattttggtataaactgtgttccactgcgatacagtttctatatcagagaaatgtggtcaaaatgtagactgatagtgagacagaatttcaaaactttttgacatttgtcccattgttaaataacttgtttttttctttgttttttttttttttttttttttttttttgagatggagtctcactctgttgcccaggctggagtgcagtggtgctatctcagctcactgcaagctccacttcccgggttcacgccattctcctgcctcagcctcccgagcagctgggactacaggcacctgccaccacgcccggctaattttctgtattttttagtagagacagggtttcaccgtgttagccaggatggtctcgatctcctgaccttgtgatccgcctgcctcggcgtcccaaagtgctgggattacaggcatgagccaccgcgcccagccataatttggttttaaatcaagcacaagtcgtaatttccattgcctgggatgagattcatgctaataactaatatgaatgccaatgaagataagaattttacctttgcatgcaggtgaattacatcagagcccattagtcatcaatttgtagagactgacaactccacatttatttcaaataaaagaaaatgtagtagtcagcatgaggccagaaaacaagccagcctgaaattgttacccatatttataaaacatactttctatgtttccgtgccttcatcgtagtgcaaaatattataaatgtgaggcaaagaaagataaatgtgagtggtaaaaattggcagactcaacatcttagtgagagagatagatttacttaagggaaagtcagtttggaagtattgtaaattatataatgatatggcataaaaaggcatgatccagtctcaagcatcttcttatgtctcacagaaacaggagttaagaaaaccagcatcactgcttacttcccacgtgtcatctcctgtgaatgctccaaccatgtccactttgaagtttcattaaataaaacacattaagccgggcgcggtggctcacgcctgtaatctcatcactttgggaggcggaggcaggcagatcacttgaggtcaggagttcgagagcctggccaacatggttaaaccccatctctattaaaaatacataaattagccgggtatggtggtgcatgcctataatcccagctcctcgggaggttgaggcacgagaatcatttgaacccaggaggctgaggttgcagtgagctgagatcgcaccattgcactctccagcctcggcaacagagcaagactgtctcaaaaaaaaaaaaaaaaaaaaaaggtcaaatacttgcttctctaccagtattatctgcaaaaacagaagccttccactctgatttataccacagtcagacaaacccaaacgctgtggatttccttctccttaaccaaatggtactgttttgagccatcttctcctctgttgtaggtttggactaatccagacaaaaatagtgagtgagattccactagcctgttgaagaaatctctttcctaaggagaaaattgggaccaggagcagtggctcacacctgtaatcccagcactttgggaggtcgaggcaggtggatcacttgaggtcaggagttcaagaccagcctggccaacatggtgaaaccccatctctactaaaaatacaaaaattagctgggtgtggtggtgcacacctgtaatcccagctacttaggaagctaaggaaggagaatcgcttgaatctgggaggcaggggttgcagggagctgagattgtgccactccactccagcctgggcgacagagacagactccatctcaaaaaagaaaaaaagaaaattgagcagtgcattacggaggctgacacagtacaattcgcctcctcaccccctccacactcacttccagacatcagtgttcctgttttgccagtcatctcacaacaatgcatgtccaagccacgctgtgattagagggagaatatgcttattacccaagttcttcgcatgttggagcagggagaggccaagggtggtaaaccacaggaaatttccatttgccctccgctgcggcactctcactctatagggaagttagttgttattaggtaataatgttcagcggaggttggtcactcgtaacaacagacagatgtgtaatgttttatttgggttagccagctctctcacaaataaagggcctgaaattaaactgtctttatgaaaatattcagtaaatgatacctctggcttattccagtgctcagattctttgccatggaaaatggcaaatgagtcccctgttgggcccggaatctgtttaaacttgtctttgtcgagtacagaagggttgatgttctatgagattaaaaaaaagtttttaaagaattcgcatcgaggagtaaagggaacaacgatgcaaaccacatttagagatggaaaagaattttttttagtacttatggaatttcaaacaataataatggaacagaaacataggaaaaaagctacatatctgaccacagaggcaaattgcattattacatgctcacatgcaatgcaaatgtggattggtctgtaaaggaacactttttgcttttctaatgtatagtagggtgagaggagcacctctccaatttgccaaggcatcactagcaaactccagctaccgaattgcttggggaaattgagttcttttgaagacaggttcttgggaactgtaccccaagaacttctggttaagtagctcaggtgtggagcctgagagcctgcatttctgacgatggagatgctgcggttggatgaggggagaagggtcacactattctataccaccctgtttccagtagccagtgagatggataactcatctcaacatagagtgtgaccacgaagagagatacctacccgtaaaatggactaagattcacaaaagcttgtttccagctctaaccttgttactggctcagtaaccttgaacaagttactcaaactttttgatccttttatctccctagatataaagtgtagagtttagaccagatcagcactcctcagtgttctcaaatgtcataaaaaggctaaacacacacacacacacacacacacacacacgtatatatagctacagttaagcaggttttataactgtaggacgtctcagaaactgtaataaacaaatgtgcaatgtggctctccaaagagtgaaaacaatggggtgtctgggggctcagcttcagctccagtaggcaaatccttccaaaagtatttaaccacaaattcctttatgtgtatggaacacctgaatcacacacttcagcaagagaacccctaatgtcctccagccttaactttcccatcctagaatctaggttctccccacagtcctccaatgttcccagccaggccaatgctaaaagcttcccttaatgatacccattatccaaggaagaaacctgagagcaattttctactacctgtttgcttttttccagcaattctcaactttttgccaagacattacacccgaatttctatccccaaggaaacattttctaactaaaaactccacctggccactgcagtacttatatatttaatcccaatgactttctccattcctttgtttgaaagtaatgagactaaattttagacaatctaatttcttggcttattcattttctccatattccagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggtaggacccagtcatttgcatttttatcaacccctccaggtgattctaaagcacactgaagttagagacacagtgttgagatcagaagcatggactatggattccaacataccttgtgctatatcacagttcctttgtctgaaatatgggaataatattagtacttacttcagagtctatgtgagaattaaattaatatataatacctaatatcaggcctggcacagggtgagcaatgagtcaattaattacagctgcttaatctataatggatgctgacgcgtagtgagcaggaacttagctttgtcacactgcaccacgagactcctttgcaagctaatgctgatgatggtggttagataggagtgcagccgtgggagcagacagagctggtttgctcaccaggtgctccatgtattagctttgtgaatgcatgtaaattatttaatttctctaagcttagtttcgtcacctagaaaatagagaaaataatttctccccaaggtaaagagagggattcaataagataatatctataactgctttgaaaagtgcctggacccttttaagttgtcccttcccaaatgaaagctatcaatgacctaatgacagtggtacctgggcggcccagtgtgtctatgtgattacagatcctgaggccactaggtccttaaacttgggcttcttgctccacaaaatattagaatgataggatatgatacccttacaactttccctaaaaagctatcttgtcatgataaatgtaaatattgactcagaagtaatcaaaagataattagtcaccttttctatgttgttcttagggataaggcaagccattcttgccattacaatcttgttgaatttgggttctttttgtattcagtgttgagtcatagaccaacattcagagtttacattaagactatttcacaactcagttgggtgcagtggctctcaactgtaatcccggcactttgggaggctgaggtgagcagatcacctgaggtcaggagttccagaccaagctggccaacatggtgaaaccccatctctactaaaaatacaaaaattagccaggcgtaatggcgggtgcctgtaatcccagctgcttggaaggctgaggcaggagagtcgcttgaacccaggaggcagagattgcagtgagccaagattgtgccactgcactccagcctgcgtgacagagtgagatgctgtctcaaaaaaaaaaaaaaaaaggaatatttcagaactttatatctttcctttaaatgcagtaccttttaggtcaggcatataatcctaagataaaaaaatatgtattaatcgtgaaaatgtctctgtggtcaggtttcactaggttttgccttgttaacaactctaagaactgtgtggcttacagcaacaagaattttttctcacctgtgtttcaagtcagctgtagttgaattatggctcagttccaagtttccttcttcccacttaccagaaggaaggaacagcccaatccatgacccacccacatgcaaggcaagccatgtgatgatcccgacacctctcttcaggcatggtgtgggttactgctgttcacactccattggccaaagcaggtgacagggccacacctgacacaagggagtaggaaacacacaccccacccccgctacgcccgggcagggaaagtcccagtgaaggatcctttgtggaaggacccagccgagaggcacagcaaatagttgggagcaacatacatcaaccacaacctcccaaattgtcacagctctaccaatagtttccaagttcaaacacatcttccaaacacaggtcactgagaggaaactagcttccaagtgtgctgtaatctcaactggtgcttcccctgaaatcctgataattcccctggaggagaatgagtgattcttcagcctccaaggagctgtcattctttctgggccatccttcagtcctcagtagtctaaggaaaaagtgcttttgcagaaggaaagtagaatttcctcaggagatacaaaccgaaggattgccctctggaatctgctgagaatccactttgtccaccttgcttgttttcaatgaacatgtctgtttctgaggccacttggcaaagctatctgtgcccttggctggtatggatgagttaaaagctggactttgtacagtcagaccagcctttaaagcggatccttcactgctgcgtagtgtagggaggaaaatggcccaaggccaaggccaaaggtcatggtgcatgtgctcctgtgaccacagtcgagggagcccagggaggagagctaagcctttattctcaattgttttaagcctcctgagctcagtgaaccccaagtagattcttgtcaagcattttttttctacttaatatttaaaacggtgatacttaaagtcaaatttaatccaggcattttttatttctggacaaagagatcattgaaaaattaatttgtcagaaatatatgacacgcaaaaaagcaaaaagctttttaagtaacttttcttacaaacaggaagctatgttttttcagagcttaaaagtgagatccaccacaagttaattttagtctagaaatccaaagttactatttgatttagatttcactctttatgcctcatcaccctggttaaaagacgtggaatgagctcgctgaaggcctagttgaggaaccccggttctggggagccactgtctccccatttttctgtaagtgagaaatgttttttctaaggggcctttgctttgttagttcactgtgaaacgcagaatgaagttttctcgagatgggcaaattgaaaatcttcaaaatctggcctaacagagctctaagttttaaagacatcaatgtctttaaacattgccatcatcaacatggcaatgggtactacccttccatttcccattatccttgctgtgtccccaacactggaagtgtagttctccatatagctaagtacctttttcaatgtgccttctgttccattctgtttcagagtgtgtttattttctttcctttaacttcagaaaactaatgctcacagcataagcactcagtgacctcagaccattaatcttttactggtttgaagtaggagaaagtaatactgacctatccattcaatagttgtaagaacttcacttaggtagatatcgccattctaaaaattgcaaccccaacccacaaactgaaacgatataacaaaaactgcagaaataaacattatttccagaaattaaagaaaactgttaatggtttatatgaaatattgcttagctgggaggattaacccttttctcatttgccctgagaatactcactggcagcacttgaggctgcaatatttacctggagatgattttgccacacagtatattacttttattattattttcatatcactctagtatatcaactttggaaacaaaagacaacattctatttagagcattctgcttttagtagtggtatttttatttacaaaatatagtaattcttgatcgctgaaaatgtcaaatcctggaaaacacagcattcctacacatggtgttaacattggtctccaacagttgttggccagagattcatttgatgaatccaatttttccgaaatagacaattctgatgattcagatgattctgatgttagttctgtttagaaataactccaagaacaatttttatgttttactttcacattgaaaatcaatcagatttgcttcagcctcgaaaagcatgtttatgtaaaattaagtgagtactggtggcaagctgcacttttttttttaatgggaaaaaggttaagataggggaaattagaagaaactattcttctctcattctttgtgtttttatcttttggaaaactgttattgttgcttaccatgttagaagttaagccaggtctattgaagaatcactaagggaatataacctaaggcagtaacataaaattatatgaaataagagtatgtatcaacactgattcaaacttcatgaaagaagtctgctgaggaataaaattctataaattaagagcctatgatgaagtgcaattcataaagcctatgggtaagattgatgggcacaaagaagattctgggtcttaatagagcaatgacaaagaggtcatttgccaaacatgctgtggccacactggcaggatccagcctgtaagaggatgcacaggttaattgggaatactttaactataagagagtaataactgtaaataattggcagatcagaagaaacgtaggaagtataagtgtgcctgtgtgtgtgtgagagacataaaaatatatggatgtagacagatggatgattgatagatagatacagatcatagataattgataggtaatagatcaataattgacagatgatagataatatgcaggtagatatttagaccggtaataaatagatagataattgatagataatagattgattggtgatatataataaatgatagattagagagataattgatagataatagattgatagaagatagataatagataggcagatagcttaggaagaattattttcaaaaagtacatgcaaaagaacctcttgaatttaaaggagattacatgaaactgtggatgtttaaggggattttgtggtggactgacaggaaccctgggctagcttccaaagactttggaccttgttctttctgccaggacccagctgtgtcaagtgggatggttctgacaatcttttccactctaatgtcctatgactcaacagtagcaatgcatttccacaggcggtaaaaatattctagactcttcccttccagcgctcactgtttacttcctctgcacttccccttcctgcctccccgtgtgccggtcagttcatagcgggcctcaatgagggtgggttaaccctctctttccagggtgttttgctacggagctccctccaggggctgggaactgtgtggtgagggctgtggttggggttcagcttccttcttaaatcgttccttgaacctttaccctattctgtgcactgtgccgatttccagggattggaaggtaaatgccactgcgtaactcttagaaaatcatcgggggtcagttttactggggtgcacttggtaaccatctatgaatccatgtgtccctctttctttcaggcagtagcagaatcccatggtagccaggtgggtgaaggggagcgaggacgttctacctgccttgaagaagacacctgacctgcggagtgagtgaccaggtagtagacggttctgagggcatcacacacttgagggagggaggaggacagagagggccatggcaccctttgactgctgagtgccagctgctctctttcccactgagaaatgctgcccccaacacacccagaggctctaggtcttgtcctgtgatttctgtccaccaagacttgataggaggtatgatagatgccattaactccagcactatatacacaggactgcagcaaaagcgctctcagcagaaagaggaaacagatacagttcatcccaagcctggcttgctgcccctttgaaagagagtttcaaacagaagcttcatggtgctgccttcataaaaacagggccaagctttccagaatctggcagagggctgagtgcccgcaggacacttgtgtatcactcacactggaaaacttaatcctctgtttttatttcagtggattgaatggcatgcagtttcctcagcagcttaaaaaaaatgcatgcagtcacttgcagacaggctgcatttgtctctgctggtgctcatgttacaagtttgtctgtgcatttgggcatgccagaatggcgtttcatttccaaacctttattgtggtcactttcctcttcgttacactgagaagtgttgctgagggtatagtaaggccctagttcatcaattatatcctgtacttttcttctaacttgatcccaagaacagtggaatttgcttcaaggtaaacaaattttgaataatttatggcccttcttttcaacaaaaatgaaaacgtgactttctaaagaaaagtcaattacaagggggcatttagtaaataacacactcttaataaagtaacaggaaaattaaaatgcccagcagacccattgcctcctgaacaggtgtttgctgctaatggatacagtttccatttccttgaagggatttgcccagaggattactttcacaacttctattgagataatactgctctaacagaaagagcaatgcatgaatctgtatatcagttccttaataaaagggaagatttttttagttcctaaaataccaatgaggtgaagaaaaacatgccacccaggtaaagttactctgtaatcacccgcattatctttttcaaggaatgtgggggaaatttatgtcagtcatcaggcaggtactagaagatgctaggggcctcacagacagcttgttcccggctgttaacatggagcagagcgttccctggggctgagcatgggagcccagcacttcttataggtaggtctttcctactataatattagatgcctacacttattgactttttcatttgctctttaaaatagatttcttctgctggttctgcttagttctaaggagtaaggtagaattttggtgccatacctaaatatcacgtctaaaatgacattggtagcacttttccaagaataaccagcatattgatcaagccattaataaagcctaattatttgctttaagaatgtttttggttgtttcaaactgagttttttccaaagtcataacaaaactaggagaggctgtagattcttaattattcattagattagggggaaaacgaattgctattacaaagaatatcatgcaaaaaataggttttaaaaaatgcattactactgagttttaaaaatgtatactaacattctccatatcaagaactgtttcatggatggtagattttagttatagcagtactggacttacactcagtcaaataattttaaattttctataattgggaatacatggtagctgaatataagcaaacatattactctatgaaataaatgcataagagtttgttatcacaaaaaacagcataacattatttttttgaaacacaaggctctgttttaacactttaccttgtttaatagtaacaaaacccctgaggaataggttgtattgccattttaaacactggagagcaaaggtccagagaggttaaatagctttctgcaggtcacacagctgatgaattgcagagtcagcatttaaccccggtctgcttttctgcaaagcctctgctcctcactctaccctaccgaccacctaagtatagatcagttaatcttgccttcagaattctcctttcttgtgtacttccatgtacattcatacttacttcacatgatgattctattttctggaagttccaccacatatggcgataatgaaacatctttgtcatttctctaagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtccaa

SEQ ID NO: 2637 - DNA, 29319 bp, Homo sapiens
ccagatctctgggatcttcagctgagattgggccccagcacctggactcaaggtaaggccccttaggatgcttgtagctgatcaatcagggtagtgcaaaggaagaggggaaaaagccacccagaccttaaaggagatttctggaagatccaatcaaagtgattcaccttaacctcaggcatgacttttccccattatctgctgtttttaatttcaagtagtataaatcttactgatctgaagaagacttctgcttctgaaactaccagcgcttaacaatgattgagccctactctatgagattgcaaataaaaatatattaaccttggcaggaaatcaactgattaatacttataccctacactctaaagactggaacctcaatttatctgcataaacagaggctttgggtataaaagtaaaatgtagttggttatgccaaagactgctttcaatagtaatgcaccaaacatgcttttgaaaatagcaataaactattcatttaggttagatatacaaataagtaactttcagagttagcactaagttttaagcctcaaagactttgatttcagtgacaagatgtgtaaatgcagcggttagaaaaagtacacatactgaggtttctttcaagattatatatagtattattcaaaagtcttattgtatatgaaaagtgacaagatttttgcaatatgaaacaacagtagctagctaatactctagttacctttacagattgtctagttggtcacattataccttaatttttcaggatccaaccaaggcctggttaactcttactggcaatgtttgaaagggatgaaagaggtcctatgcatattactctaaattaatcttagtgcaggaagacaagtcatatttgaataactttattttgtatccctagctactgtcatcctagtatttgaaaagctccttttctcccaatgttcagaaagtcattttccaaacttgcaaatattaaaacctattcatgtctaatacttttctacttggtctatttccatgtcctgtcaatgacctatcaattaccctattcaattacccatgtcacttgagatttctcccaccagaatttaggttgcatattttcacagggcaatttattttaaaatcagaatggtccataaaactaatagctttgtgtgcacagacctaaaagatttgtagtagctctgcagctgcatttttgaacatcaatagttaaacgatcaacataaatgttaaagaagtaaattaactttcagaatttcacgtgtgctctagcattcaccattgaccatgctggaagaagactttgaggtcatttcatccaaccctctcattttacagatgaggaaaacaggactaattgatagctagcaatactaaattatagctcttctaaaactagacagcagcgtcagtaggcttcttcatgtgctcaattactgtatggattccacgagttgatgagcgtgctgtgaccttgagcatttacattctgtggttttcaaatgtttatgtttctaatgtggtatttgtaaacctgggccccagtaacctttaccactgaggctttgccaatcccaactctgggcagcccacctcttccatatgcagcagtgcttgcaggctgttccgcctgggcaaagtcatgttaggtgtaagcaaagacgtgaactagtgttcatgcttgaaaacctcacagagacctgcctgctggctgaatcctttcttcatctcttgttgcctctcctacatgtgactcaaaagctagccaagtttgttccacatccttcagcttgttcctcttacaccaaagtgccataccatcatcccctttagtaagatcacacttctccaatttctgtcctcctctactcctcaataaacaggaagatgctgtctgtggaaaatgcacgtggagctcttgcacacgttttctataacttgtcttccttccacttccccacaactagaatataagcctcatgagagcaaatgccttgtctggactgttatctcccctgtgtctagtatagtcaaaaatagtaggtgatgggtaaatacatgtgcaataaatatatcctttcatctttccttcctatcttagggaaacaaatgtccctttcttttctgtcttacctccctaataacatcagtacttctttgtccctcctccaatattgacctctgaatcacgtcctccttcttgaaatcttgccttcttaattgtctgcttttattaatttacataggtgtccagccatctggctggcctttctccagttcttttgctggaaaatcctctcctcttctctttaatacaggcagcctctaagattgccccttcagttgctttcttcccttggtatttttcttttttttgcagttctcattgactcatatctggtcaacttttacctctaggtacaatgattcttcaatttccacctccagccccaaatttaattcctagatatggacatgcttggagccaacaccaccatgtcacctcaatacactctgcttttcatccaaatcttcctttccatccaggcagcaaactccagagtcctttccactcctgttcaacctttctacttcacatatgacaggtgtgtgaattttacctggtggcaaaccaacgtggtgattctcttgaattcatgtattacttagacaaattcaacagcctcctaaatgatctccttctagctgctctcctccctctccatctgtcttgctagatgagcctggcttcttttttcctgcagaaagatcaaacttttcagtttaacccgcatcaccttttaaaattcattgccagtgtagttcccaatatggcctcatactaacttcagataccccagtgtatctgaagaaagtaatcccagctacttgggaggctgaggcatgagaattgcttgaaccggggaggcagaggttgcagtgagccaagatcactccactgcactccagcctgggcgacagaccgaaactccgtcaaaaaaaaaaaaaaaaaaaaaagcaaaaagcaaatgggaaacttttttttgaaaagatcagaggctccctttttaaaagagcagagctcaggctcttactcacatccctgtgccccaccaaaatattctgattttattgtcctgtgtcagagccaaggcattagttcattttaaaatccccctaggtgaatctcataggcagccatggttgaaagtcgctgataattgataaaccctatggcccaatcaattgggagtacttgaaacatactttgccaccccatagttttgcctgggcaattccccttgtctgtaatcttctttctcctatttttttttcctacagaaaacacatgataacttctttgatttttccagttagaaggaatcagtcctcctcctggaaatccttaataccttttaatatatcatattcattcatgtgatctaggcagaccttgtgttagatatggacaaaatggagagaaataagacaaggtccttgtctttaagcagcttacagtcttgccagctcactggttacacatgaactagtgagtatcaacttttatgatagaagtgtccatgggatactgttaaggcatgaaggagcctattctgcttggcatgataacaatttatgtatatgtcatctcttatatcaaatggtatactttcgagggctaagatcatgcatctctcacctttacgtatttcaaagaccacagtagtataaaatgtttgctgaataaatgagcaaatgaatgatgttttggtaattaggagtcactggggaataatggcagctcttaggaaatggtaccatagttccattcttggggtagggctgggcgtgtccccatggagttcacagaactatgtcataatttcagtactaaattatgtgtgttttacagtttctctcaatcacccattctatgttttatttaaaatggtaataggaatagcatgttagaaactgggtcctgtactcattaacaaaaagaagggagcaacagacattggggtctacttgagggtggagggtgagaggaaggagaagcagaaaagagaactattgggcactgggcttaatacctgggtgttgaaataacctttacaactaacccccatgacacaagtttatcaatgtgacaaaccttcataccctttttttggtaccccgaacctaaaataaaagtttaaaaaattatattttagaatatattcaaaaagtaggatattatttctcaaagaaaacatctgaattcatactttaaaaatattttttaaaacttgaagtttgatcaaggcatttacatcctaggagacaaaagcaatcatttcagtatgcattctagatttatcaactgcatacatattttaggaagattttaagatatttcaatataatatctaaaaatgaccacttaattttagtaaaaagagactcccaccttctggtaattgacaattactatggtctgagagtgtttagattaaaaaattgtgtgtgtgtgtgtgtgtgtaaaattatcacaggaaaatcaatacatcaatagtagcaccaaaaaagaaaaaaaaaaggaaagaaactaggtcctatttttcatgactaagaagttgacaatggtctttccaaattaagactcggcatctttgatttttgtaaacatatcctggagatcgaatgtgaacatttgatggctgatgggaagaattgaggaggattaggggagcacttgactttgccatgattctcaagttaaatccttggacctcttaaagatgttgttgatgaagctgctaaaatggtcaccagatgaatataaacaagtaggacccgcagtaatttccaggctaattttgtgcacgtgcgtttaggggcgagtcaaattaaatgaatgaggagctgatgttcatgtgaaagtaattactctcctccagtagaaatcctaatcctacaagtaactgcagaaataattaatcataactaagaagcaaaccactctcagggagaaaagctgtatctgaacttccacgtgctcttggaggatacgggtgattcacggcataagagtcatctaccaagtcatctgcaagagcgagtgcagcttccaagagggtctgagtcagaacagataaaaggaagttcttcttaactcagaagatttcaacactggggaagctcatttcccacagagatagaaaaatgtgcactataaatcactctcaaaaagcaatttagacaactacacaggtaatgataaatgcatggagagcactcacatgttttgggttgtgtttttgaccttcattcattctttatagattattaatccacggattaagtcattgactcatttatagtcatgagtcattaaaacttttctggagcatctaccacatgccagcaactgtgctacttagggtacaaaggtggacatggcccaacccctgccctcaaagaacttctagggaacactgactttgcaggcatgattccgtctgcatcacgcatcagtaaacagctatgtgtactgtagggtattgagacacaatgacgttccctctgctcagctcatcaccacaaccaatgtgtaggagcttgctttttgagacccagcggtgctttctataactggaagattccaagtttcctttgcttccatttatgcattcagcagacattaaggccctgctagaacctaggcattggcatgtacaagatgagatatggcagcttgcattccagtggaaggtggtggggtgtgatggatgaagagctggcttttgagtcagactacaatcttaaacattgtcgccactactagctagttgtgtgaccctaggcaaatgctttaacttatctagcctccatttacttatttttaccagcattactctgaagtgtggagttatacatacatgagctgccgacacagtactagttacatattcattctcaactagtggcagttgttggttggatcattattataattaaatatacacaagcaaaacagatatctctagtacactgagataaatattctgggagacagaagcataggcaatcatgtagagaaagccccaaacccatgggaacaggtggagaaagcacctacctagaaagggtaacaccccaaaggatagacatgagaacgctggccaagacaggaggtgggctttcgggcagatggcatggcatcaagtcaatcaatagaggactaatccatctgggcaactgcaagtcattctgcatgacctgaccaggtaacaacctaaggagtggctggcactaaggcaggtggggccagtttctgaagggtcagtttcaggagctgaggctttggtttgtagacaatggggccactaagctgggcggcagagtgctttagggacaccactgaggagggactatgaaggatgctatagagagaggacaacttgagatggggacctcaattatgagcctgtgctgtcatgcaagaaataaagtatgtggatctaaaccaaggcagtgtcacccaagaaagaaaatgtgtggatctaaaccaacgcagtgacagtgggaagggagaaaatggacagcttcaagggatgttggggtagactcggggtgctgagtatttttcagtgcctgagggtctacgggaggaagggagttgccctgggtaatggataatgaagctaggctgggtctaatttggggtgtttgtgggcaatcaaagggaggaaccacacacagttgactgttgttctggcagtcttgcaagagcaatctggaacacaaaaagtctaggcttcatgaactacaaaggtaacatctgaaaccatgggagtagatgcaggagtgtgtctttagtgaaaataaaatagttggagcatggagccttggagaaaatgccacttcaagattggcagaagaggaagaacctacagatggaactgagaaggcatcagaaaagtagaggtcaagttgagagaagagagtagcagcagactgaaatgctatggaaatatcaaggaagataaggaatgaaatgtatttgccagctgagttgtaagtaactctgaccaagtggagtggtgagctgagaggttactctcttggttgaagagtaatcacccagccctcaaggaagtggaagcaaagtatcgcttctgtcctttttaaagctcttctccatatcattgactctgctccccaaagcttggcttttagtgaaagccattctatttagacaaactcattgtctctcctctcaaccccaagacaagcattttgatctctttaactccatgggttttattaccaatgaatgaaataggacatggcacacagagcagacagaaggccattgccaaggtctttcaactggggtcccactctcaattttacttcctgaaagttcaatgtcttggctgaaaacagggctgaagatagatccaaggaagaccactgggaattggccaactaggtttaaactggggaacaactcccctcaagtggcaattttaagggtcttcatcctgcctcattggctttaatccctcttgaacatgtcaaagtggttggaagactgagtcctggtgggccacattgtgtttctgtggactgcggactagtttcagaggaagcacctgtctaacttaaccagggatcacttaggatgaacaccagttacacagtatagaagacataaatatttgaaattttatttgcagccactgttgcacagtgcaagctgtctcagaaattaaggcatatatatagttcaaatgggaccaaagtagtcttttggaagtcataatagggcacacatacatgaattgttgagcagaccttgtaaattaagagattcattgtattcaggcaatagtgtgtgggtgtgtgttcgctttctttgggaaaacagcatttgtaagccactcactcccaacatcaggggcacgtcagggtgagggtatatagaggtagctgttattagtgagaatataagcgacgcctgacttagcactctgttactgttagcactaccgaatctttgatgactaggtgtggtcaaaatcttggtttccagctatgtttcccataaatgaagtttccagatataagccaaatgcttaaacaaaattgctgactacaggatcattttgtaatactgtatgggtgatttataagctgtgtttttttaaagaatgaagtcatctagtggctttgaactttctccccataggtgaagttataagtccagcaagctcctcagtggctcctttctcaacagtcatgtgagagaagccagcctcaattaagccccacggcattcactgatggaataaattaccttctattgtatatgtctagagtgatgcttgctataaccatccatggaagaaatgagaacacagtcactcaaaccattttctgggttcagtaccgtgttgtccagatgaggaacagtggctgcaaaaggccgtttgctatgcagagtgtgagctttcacctccagcctcagcctcgcctgggagctggttagaaatgcaaattctcagacctactgcagaccttttgaataataatttgcatttaaatgagccctcagggaattcgtatgcaagtttaatcagtattggtgtgaagcaatggattcaaaaattatagcctctcgcagcacacacaaggatacttagggacatacatgcacaatatatacatttttcgtcttgctctaacaaattacatatattttatttatttttttcaacttttattataggtatggggtacatgtgcaggtttattaaacaagaatattgcatgatgccgaggtttggtgtataaatcctgtcgtgcaggtagtgagcacagtacctgacaggtagtttttaaaaccaccccacagccctctagtagtctgcagtgtctattgttcccatatttatctccatgtgtgctcagtgtttagctccttctattataagtgagaacatatggtatttggttttctgttcctgcattaatttgcttaggataatggtctccagctccatccatgttgctgcaaagaacatgatttaattcttttttatggctgcatagtattctgcggtatatttgtacaaaattttctttatccattctacatttatgggcacctggcttgatgccatgtatttgctctagtgaatagtgcagaggtgaacatacaaatgcatgtgtcttttggtagaatgatatagtttcctttgggaatacacccagtaatgggattgctgggtcaaatgacagctctgttttaagttcttttagaaatctccagactgctttccacagtggctggactaatttacatttccatcaatagtgtagaaactttccctttctttgcagccttggccagcaactattttttgactttttagtaatagccattctgactggtgtgagatgataactcttcgtggttttgatatgcatttctctagtgattagtgatgctgagcattttttcaagtttgttgactgtttgtatatcttcttttgagaagtgtcggttcatttcctttgcccattttttttaaatggagcaatatgttttttgcttgttgatttattcaagttcaccatggattcattttaaaatatgtataagatataaacacttaaaaggataaagtggaagctacaattgaatacttctatcattttgtcactgtccctgcttgggttactggtgtaccccacattggagacatctggtgtaaagaagcaaacagagccgaaaggaatcttagaactctttgtctatgatggtcagtgtactggggaacatgaaatacacagaggaagtaatttgttggatgaaattgaatatacttatgtttgcccatagtttttatcggttttgtcattttgagagatgtacaactaattttctcttcaagatagaacattgtggcatattctttgtgctacgaatcagaataggaagacgaaatctttatttctaattgaattgttcaaatcagtgaaatattcttcacccgaacaatgtgcctagctgtggactggattcctctctgggattcctctctgacctagaacgttgggcatcataaccttaggcaagtgacattcttactaaatcggacgctgagtccccttgaatggcatctctgcccaccgtgtgcctcccttaaacattaagttcctaccacatgccaggccttgtgtttgccactcaggatgaactactgtgcccagtctatggggaaagctaaactccaagactgatcattacagcagcacagtaagtattatcatgaggtgtggacaatgagaaggcagaagagaggaacaaggtgaacgctacctgcatgctggaggagatgacatttgagcggggcctcgagggatgcgtaggagtttaccaggcatagagcaaagaagaaatatggaataaaggggtcagcctaagcaaaggtatagggcaggatatctgctttatcagcagtatctctgggtgaagtgcaaactcttctaattcagtcaatgaaatgaagccttaagatgactgaaaactaggttcttggatttgtgcaatagatatttggaaatatctctgagagtaaatgatttcataatgtttggccacaacactgtgtggaaagtttctttgtgtaatataatacagaaagtacttctcatttacagtaaaatctggaatacttggaaatggtctgtgctagggaaactgaattttcagattaactgcataaaaatggaaaatctggttgaaaaaccttcctaattttgttttcctttagagagataactgctgttaatattttagaggtgttttattttgatcttacctagagagagaaacagagagattaccctgcatatttagctgtatcaattgccttttaaaaaacatatttagcattttttcatgatttttaaacactgcataatatttcagcctatgagtgttttataaatttaaaaccattcctatattgttggtgactcagattgcttctaatgttttaatatcataataaatatagagaacactcttgtacattatcctatcatacatttcctattaagtcttaaaagtagacttactgactcaagcagtctaacataaatagtttaaaactttgagtatacattgtcaaattactgcctccctcaaaaaagttatgctagattactctatcggacaccatgcaggaagctcttcatttctgcaaactcgtcaatgtagaatgttcacatgtcttttaaaattttcggtaatttgataagtgaaaagtgaattcctggtgcctttgtgtttcttggactgatggtccctcctcagtctcctttgcctgtatctctgactctgcctggtcttaaggctactcaggctcagtctgggttgctgcttccacactactgtctaagggggaagctcctgcactttcatggctcaaattccactcgttggcttatgtgctaaaggcatccctcctgtccaggtgtctctgttgaaggccaggcccatctgcacagaccctagtgcttacttctctttaggtgtctccaggcagcctccagtgcacaccttcaaacctgcaccccagaggtgagatcctccttctgcatcgggattctgcacaagcgtgagctccatgctggtataacacccaaacattcaatctgggtgtcccataacatgtgcataatgttaaaattacagaggaagatccagtgtcctctgaatcagtaagatagcctccgcccaccccaacacacctcatttccatgccaggaagcctggagtcatcggtgagacttcctcttctctctgccttgtcttcttaacatccacctgttggagacgcctgttgactctgtctgggacctgtcactcagagctcctggctagtagctctcaagctacaaacaccgcccttgtccatgcatcagtaatttcaactcagattactgaaagtgccgattaaacagactctcagcatctatgtttgactctttccaatacattccctatgctgcgtttaacatgatcactttcaaaagcaagtttgatcctttctcttccttgaataaaaccccaagatactccttgtgctccaaggatgggggtgacggtcctcaaggagcccacaaagccacatgcaggggcatggcatggctctgcccttgctcctacctgacactgcttccctctcgcctactcaatatcctcctcgtttcctggaaggtgccaagctccatgctccaactccagactaggacatgttatataccccatgtgctagtctctcatctatccttgactttctccccagttcttcccacaaatgtctttaaatcactcatctaatgatgtatttaatgcctcttttccctgttttcttgcaaactacccaagagcaaaaaccaagtcactcttaatgcttcatcagcagcatcctgtgccatgcttagcacatagttggtgctcaataaattcttgccacacaaaccaataaataaatgttaaagtgttgaaatgtcttttcaccttttcaacattttttgaattgcgtttctacacacgttgcccacttacgagaatgaaggctcttgttgatttgtgaaaactttatatgaaccctctgctgttcatccgtggtaaatgtgattccttttgataagtcgtattttatgttttatttgtcgtatgcatatgacaataacagttaacacttgtgtaatgattaatactaatcattatactaatcatacgagcaggcagagttttatggtgctttatatgtttttatttcacgtgaccctatgaggcatagaaatgatcatcatcgccattctgcatatgaggaaaccgagtctcaaaggggttaagaaagttgtccaaagtcacacagctggtgttaacagaagcagggtcctgtgctcttaatctttacgctatactgcctctgaagaattgtttaattttttttaagtacagaagagataatgttcaacctgacttttgaaggacaggtgggagttaaccaagaaagggagaaaatgaagaaccttcaggaaggaattcatgtgccagatgtgggctgagagggcacccagctgctcaggaaggggcaagtatatacccaggctctgttctgaggtgaataaagccagagagggagcgagagccagggcttaagggtctttttggttttccaagttgttcaggatttgtcttgtcagcagtgggagataccggaggatttatgaaagggagtattgtctcaattagtactctagatgagtaagctttgtctttcctggtaagaattatcttgaaaccatggcaatataaagttgcatgtgactgagtggtatattaactgtaaaaatccaccttcctggctgggcgcggtggttcatgcctgtaatcccagcactttgggaggccgaggcgggcggatcacgaggtcaggagattgagaccatcctggctaacacggtgaaacctcgtctctactaaaaatacaaaatattagctgggcgtggtggcgggtgcctgtagtcccagctacttgggaggctgaggcagaagaatggcatgaacctgggaggcggagcttgtagtgagctgagatcatgccactgcactccagcccaggtgacagagcgagactccgtctcaaacaaaaaaacaaaaacaaaaacaaacaaacaaacaaaaatccaccttcctacttccgagaagtgctacagtaaggctatgaagaccaagcattatgtatgtatctgagctgttttctgttatttccccctctgtttttatgtcagaagaaactgtaccattacttctagagtagaagatgttggaatgtctcctcattggtcttactgttccaatcacgtgagcaccaatgtaatgttcattactaacattagtgcctgcaagaatatcctactggaaagggaattagctgtgattttgttaagtgtccagccaattttcataaaagacacagtatctgagatggctgttaaacatgtcaagagattgtgtacgaggggaataaatcaaggaagactctataggttggtctgattctgtgatattaccagaattactggtaatatctacagcatttagaaacttcatccacagtcagatttaatcccagggctatgaagcctggagaatatatgggtagaactcaggagaatccacgatctcacatgaggagaaaagaacagcagtttattttagatggcctctaactaaaatttgtattgagtgtgtgcagcaaaccacagatgtactagctgcaactgtgactttgtcatagtggaaatcacagacatttcaatatcacattccagtcatttcagagaccttgaaataacattgctgctcaccacaccttcaaaacattagctctgatttaatgcttggaaaagtataattttgttttttcagtactgtaataggtgcattttaatatcattggtgtcttctgtaatctttgtgactttacttttatctgtttaaacactttattctgagaaggcaggcatgtgtctcactagtccaccaaaaaagaccataacataaaatgttaagagcccctgagctaatatcttaaaaatgagacaaacttcttagcttttctgacacctctggtaagccatgcatgaaaaggctgcacccccatcccgcagtggttagatttgttttcagagtttttagtactgggaaaatctggattgttttttttcttctaagaaggatggctttacgttaaaccctgtctttaagtttcttggccttaggaatgactcttgagcataagtttgcttttccctagggatgccagatttagcagatttagcaaatacaaatgtaaggccactctgtactatgcaaatctatagatacatatatgtaaatagtacatatgtatctctgaatttcaaataaacaatgaataattttagtataagcatatagcaaatatagcatgtgacaggcttatactaaattatttgctgtccatctgaaattcaaattcaactgggcatcttgtattttatctggcaactctaaaaacaccaaatttgggccaatagtcctccggctaattaactacagatggttagaatgtgttttcttacactgtacagtgatggaaattagttaactgccaaatgtcttaatttttgattgaatgtgaagatatttttaagtttgaaattttgtattatcattcagtgatcacagagtctgctttcaactttgggacaagcaaacaactgagaaatactaccagtctttaaagcaaattttggtataaactgtgttccactgcgatacagtttctatatcagagaaatgtggtcaaaatgtagactgatagtgagacagaatttcaaaactttttgacatttgtcccattgttaaataacttgtttttttctttgttttttttttttttttttttttttttttgagatggagtctcactctgttgcccaggctggagtgcagtggtgctatctcagctcactgcaagctccacttcccgggttcacgccattctcctgcctcagcctcccgagcagctgggactacaggcacctgccaccacgcccggctaattttctgtattttttagtagagacagggtttcaccgtgttagccaggatggtctcgatctcctgaccttgtgatccgcctgcctcggcgtcccaaagtgctgggattacaggcatgagccaccgcgcccagccataatttggttttaaatcaagcacaagtcgtaatttccattgcctgggatgagattcatgctaataactaatatgaatgccaatgaagataagaattttacctttgcatgcaggtgaattacatcagagcccattagtcatcaatttgtagagactgacaactccacatttatttcaaataaaagaaaatgtagtagtcagcatgaggccagaaaacaagccagcctgaaattgttacccatatttataaaacatactttctatgtttccgtgccttcatcgtagtgcaaaatattataaatgtgaggcaaagaaagataaatgtgagtggtaaaaattggcagactcaacatcttagtgagagagatagatttacttaagggaaagtcagtttggaagtattgtaaattatataatgatatggcataaaaaggcatgatccagtctcaagcatcttcttatgtctcacagaaacaggagttaagaaaaccagcatcactgcttacttcccacgtgtcatctcctgtgaatgctccaaccatgtccactttgaagtttcattaaataaaacacattaagccgggcgcggtggctcacgcctgtaatctcatcactttgggaggcggaggcaggcagatcacttgaggtcaggagttcgagagcctggccaacatggttaaaccccatctctattaaaaatacataaattagccgggtatggtggtgcatgcctataatcccagctcctcgggaggttgaggcacgagaatcatttgaacccaggaggctgaggttgcagtgagctgagatcgcaccattgcactctccagcctcggcaacagagcaagactgtctcaaaaaaaaaaaaaaaaaaaaaaggtcaaatacttgcttctctaccagtattatctgcaaaaacagaagccttccactctgatttataccacagtcagacaaacccaaacgctgtggatttccttctccttaaccaaatggtactgttttgagccatcttctcctctgttgtaggtttggactaatccagacaaaaatagtgagtgagattccactagcctgttgaagaaatctctttcctaaggagaaaattgggaccaggagcagtggctcacacctgtaatcccagcactttgggaggtcgaggcaggtggatcacttgaggtcaggagttcaagaccagcctggccaacatggtgaaaccccatctctactaaaaatacaaaaattagctgggtgtggtggtgcacacctgtaatcccagctacttaggaagctaaggaaggagaatcgcttgaatctgggaggcaggggttgcagggagctgagattgtgccactccactccagcctgggcgacagagacagactccatctcaaaaaagaaaaaaagaaaattgagcagtgcattacggaggctgacacagtacaattcgcctcctcaccccctccacactcacttccagacatcagtgttcctgttttgccagtcatctcacaacaatgcatgtccaagccacgctgtgattagagggagaatatgcttattacccaagttcttcgcatgttggagcagggagaggccaagggtggtaaaccacaggaaatttccatttgccctccgctgcggcactctcactctatagggaagttagttgttattaggtaataatgttcagcggaggttggtcactcgtaacaacagacagatgtgtaatgttttatttgggttagccagctctctcacaaataaagggcctgaaattaaactgtctttatgaaaatattcagtaaatgatacctctggcttattccagtgctcagattctttgccatggaaaatggcaaatgagtcccctgttgggcccggaatctgtttaaacttgtctttgtcgagtacagaagggttgatgttctatgagattaaaaaaaagtttttaaagaattcgcatcgaggagtaaagggaacaacgatgcaaaccacatttagagatggaaaagaattttttttagtacttatggaatttcaaacaataataatggaacagaaacataggaaaaaagctacatatctgaccacagaggcaaattgcattattacatgctcacatgcaatgcaaatgtggattggtctgtaaaggaacactttttgcttttctaatgtatagtagggtgagaggagcacctctccaatttgccaaggcatcactagcaaactccagctaccgaattgcttggggaaattgagttcttttgaagacaggttcttgggaactgtaccccaagaacttctggttaagtagctcaggtgtggagcctgagagcctgcatttctgacgatggagatgctgcggttggatgaggggagaagggtcacactattctataccaccctgtttccagtagccagtgagatggataactcatctcaacatagagtgtgaccacgaagagagatacctacccgtaaaatggactaagattcacaaaagcttgtttccagctctaaccttgttactggctcagtaaccttgaacaagttactcaaactttttgatccttttatctccctagatataaagtgtagagtttagaccagatcagcactcctcagtgttctcaaatgtcataaaaaggctaaacacacacacacacacacacacacacacacgtatatatagctacagttaagcaggttttataactgtaggacgtctcagaaactgtaataaacaaatgtgcaatgtggctctccaaagagtgaaaacaatggggtgtctgggggctcagcttcagctccagtaggcaaatccttccaaaagtatttaaccacaaattcctttatgtgtatggaacacctgaatcacacacttcagcaagagaacccctaatgtcctccagccttaactttcccatcctagaatctaggttctccccacagtcctccaatgttcccagccaggccaatgctaaaagcttcccttaatgatacccattatccaaggaagaaacctgagagcaattttctactacctgtttgcttttttccagcaattctcaactttttgccaagacattacacccgaatttctatccccaaggaaacattttctaactaaaaactccacctggccactgcagtacttatatatttaatcccaatgactttctccattcctttgtttgaaagtaatgagactaaattttagacaatctaatttcttggcttattcattttctccatattccagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggtaggacccagtcatttgcatttttatcaacccctccaggtgattctaaagcacactgaagttagagacacagtgttgagatcagaagcatggactatggattccaacataccttgtgctatatcacagttcctttgtctgaaatatgggaataatattagtacttacttcagagtctatgtgagaattaaattaatatataatacctaatatcaggcctggcacagggtgagcaatgagtcaattaattacagctgcttaatctataatggatgctgacgcgtagtgagcaggaacttagctttgtcacactgcaccacgagactcctttgcaagctaatgctgatgatggtggttagataggagtgcagccgtgggagcagacagagctggtttgctcaccaggtgctccatgtattagctttgtgaatgcatgtaaattatttaatttctctaagcttagtttcgtcacctagaaaatagagaaaataatttctccccaaggtaaagagagggattcaataagataatatctataactgctttgaaaagtgcctggacccttttaagttgtcccttcccaaatgaaagctatcaatgacctaatgacagtggtacctgggcggcccagtgtgtctatgtgattacagatcctgaggccactaggtccttaaacttgggcttcttgctccacaaaatattagaatgataggatatgatacccttacaactttccctaaaaagctatcttgtcatgataaatgtaaatattgactcagaagtaatcaaaagataattagtcaccttttctatgttgttcttagggataaggcaagccattcttgccattacaatcttgttgaatttgggttctttttgtattcagtgttgagtcatagaccaacattcagagtttacattaagactatttcacaactcagttgggtgcagtggctctcaactgtaatcccggcactttgggaggctgaggtgagcagatcacctgaggtcaggagttccagaccaagctggccaacatggtgaaaccccatctctactaaaaatacaaaaattagccaggcgtaatggcgggtgcctgtaatcccagctgcttggaaggctgaggcaggagagtcgcttgaacccaggaggcagagattgcagtgagccaagattgtgccactgcactccagcctgcgtgacagagtgagatgctgtctcaaaaaaaaaaaaaaaaaggaatatttcagaactttatatctttcctttaaatgcagtaccttttaggtcaggcatataatcctaagataaaaaaatatgtattaatcgtgaaaatgtctctgtggtcaggtttcactaggttttgccttgttaacaactctaagaactgtgtggcttacagcaacaagaattttttctcacctgtgtttcaagtcagctgtagttgaattatggctcagttccaagtttccttcttcccacttaccagaaggaaggaacagcccaatccatgacccacccacatgcaaggcaagccatgtgatgatcccgacacctctcttcaggcatggtgtgggttactgctgttcacactccattggccaaagcaggtgacagggccacacctgacacaagggagtaggaaacacacaccccacccccgctacgcccgggcagggaaagtcccagtgaaggatcctttgtggaaggacccagccgagaggcacagcaaatagttgggagcaacatacatcaaccacaacctcccaaattgtcacagctctaccaatagtttccaagttcaaacacatcttccaaacacaggtcactgagaggaaactagcttccaagtgtgctgtaatctcaactggtgcttcccctgaaatcctgataattcccctggaggagaatgagtgattcttcagcctccaaggagctgtcattctttctgggccatccttcagtcctcagtagtctaaggaaaaagtgcttttgcagaaggaaagtagaatttcctcaggagatacaaaccgaaggattgccctctggaatctgctgagaatccactttgtccaccttgcttgttttcaatgaacatgtctgtttctgaggccacttggcaaagctatctgtgcccttggctggtatggatgagttaaaagctggactttgtacagtcagaccagcctttaaagcggatccttcactgctgcgtagtgtagggaggaaaatggcccaaggccaaggccaaaggtcatggtgcatgtgctcctgtgaccacagtcgagggagcccagggaggagagctaagcctttattctcaattgttttaagcctcctgagctcagtgaaccccaagtagattcttgtcaagcattttttttctacttaatatttaaaacggtgatacttaaagtcaaatttaatccaggcattttttatttctggacaaagagatcattgaaaaattaatttgtcagaaatatatgacacgcaaaaaagcaaaaagctttttaagtaacttttcttacaaacaggaagctatgttttttcagagcttaaaagtgagatccaccacaagttaattttagtctagaaatccaaagttactatttgatttagatttcactctttatgcctcatcaccctggttaaaagacgtggaatgagctcgctgaaggcctagttgaggaaccccggttctggggagccactgtctccccatttttctgtaagtgagaaatgttttttctaaggggcctttgctttgttagttcactgtgaaacgcagaatgaagttttctcgagatgggcaaattgaaaatcttcaaaatctggcctaacagagctctaagttttaaagacatcaatgtctttaaacattgccatcatcaacatggcaatgggtactacccttccatttcccattatccttgctgtgtccccaacactggaagtgtagttctccatatagctaagtacctttttcaatgtgccttctgttccattctgtttcagagtgtgtttattttctttcctttaacttcagaaaactaatgctcacagcataagcactcagtgacctcagaccattaatcttttactggtttgaagtaggagaaagtaatactgacctatccattcaatagttgtaagaacttcacttaggtagatatcgccattctaaaaattgcaaccccaacccacaaactgaaacgatataacaaaaactgcagaaataaacattatttccagaaattaaagaaaactgttaatggtttatatgaaatattgcttagctgggaggattaacccttttctcatttgccctgagaatactcactggcagcacttgaggctgcaatatttacctggagatgattttgccacacagtatattacttttattattattttcatatcactctagtatatcaactttggaaacaaaagacaacattctatttagagcattctgcttttagtagtggtatttttatttacaaaatatagtaattcttgatcgctgaaaatgtcaaatcctggaaaacacagcattcctacacatggtgttaacattggtctccaacagttgttggccagagattcatttgatgaatccaatttttccgaaatagacaattctgatgattcagatgattctgatgttagttctgtttagaaataactccaagaacaatttttatgttttactttcacattgaaaatcaatcagatttgcttcagcctcgaaaagcatgtttatgtaaaattaagtgagtactggtggcaagctgcacttttttttttaatgggaaaaaggttaagataggggaaattagaagaaactattcttctctcattctttgtgtttttatcttttggaaaactgttattgttgcttaccatgttagaagttaagccaggtctattgaagaatcactaagggaatataacctaaggcagtaacataaaattatatgaaataagagtatgtatcaacactgattcaaacttcatgaaagaagtctgctgaggaataaaattctataaattaagagcctatgatgaagtgcaattcataaagcctatgggtaagattgatgggcacaaagaagattctgggtcttaatagagcaatgacaaagaggtcatttgccaaacatgctgtggccacactggcaggatccagcctgtaagaggatgcacaggttaattgggaatactttaactataagagagtaataactgtaaataattggcagatcagaagaaacgtaggaagtataagtgtgcctgtgtgtgtgtgagagacataaaaatatatggatgtagacagatggatgattgatagatagatacagatcatagataattgataggtaatagatcaataattgacagatgatagataatatgcaggtagatatttagaccggtaataaatagatagataattgatagataatagattgattggtgatatataataaatgatagattagagagataattgatagataatagattgatagaagatagataatagataggcagatagcttaggaagaattattttcaaaaagtacatgcaaaagaacctcttgaatttaaaggagattacatgaaactgtggatgtttaaggggattttgtggtggactgacaggaaccctgggctagcttccaaagactttggaccttgttctttctgccaggacccagctgtgtcaagtgggatggttctgacaatcttttccactctaatgtcctatgactcaacagtagcaatgcatttccacaggcggtaaaaatattctagactcttcccttccagcgctcactgtttacttcctctgcacttccccttcctgcctccccgtgtgccggtcagttcatagcgggcctcaatgagggtgggttaaccctctctttccagggtgttttgctacggagctccctccaggggctgggaactgtgtggtgagggctgtggttggggttcagcttccttcttaaatcgttccttgaacctttaccctattctgtgcactgtgccgatttccagggattggaaggtaaatgccactgcgtaactcttagaaaatcatcgggggtcagttttactggggtgcacttggtaaccatctatgaatccatgtgtccctctttctttcaggcagtagcagaatcccatggtagccaggtgggtgaaggggagcgaggacgttctacctgccttgaagaagacacctgacctgcggagtgagtgaccaggtagtagacggttctgagggcatcacacacttgagggagggaggaggacagagagggccatggcaccctttgactgctgagtgccagctgctctctttcccactgagaaatgctgcccccaacacacccagaggctctaggtcttgtcctgtgatttctgtccaccaagacttgataggaggtatgatagatgccattaactccagcactatatacacaggactgcagcaaaagcgctctcagcagaaagaggaaacagatacagttcatcccaagcctggcttgctgcccctttgaaagagagtttcaaacagaagcttcatggtgctgccttcataaaaacagggccaagctttccagaatctggcagagggctgagtgcccgcaggacacttgtgtatcactcacactggaaaacttaatcctctgtttttatttcagtggattgaatggcatgcagtttcctcagcagcttaaaaaaaatgcatgcagtcacttgcagacaggctgcatttgtctctgctggtgctcatgttacaagtttgtctgtgcatttgggcatgccagaatggcgtttcatttccaaacctttattgtggtcactttcctcttcgttacactgagaagtgttgctgagggtatagtaaggccctagttcatcaattatatcctgtacttttcttctaacttgatcccaagaacagtggaatttgcttcaaggtaaacaaattttgaataatttatggcccttcttttcaacaaaaatgaaaacgtgactttctaaagaaaagtcaattacaagggggcatttagtaaataacacactcttaataaagtaacaggaaaattaaaatgcccagcagacccattgcctcctgaacaggtgtttgctgctaatggatacagtttccatttccttgaagggatttgcccagaggattactttcacaacttctattgagataatactgctctaacagaaagagcaatgcatgaatctgtatatcagttccttaataaaagggaagatttttttagttcctaaaataccaatgaggtgaagaaaaacatgccacccaggtaaagttactctgtaatcacccgcattatctttttcaaggaatgtgggggaaatttatgtcagtcatcaggcaggtactagaagatgctaggggcctcacagacagcttgttcccggctgttaacatggagcagagcgttccctggggctgagcatgggagcccagcacttcttataggtaggtctttcctactataatattagatgcctacacttattgactttttcatttgctctttaaaatagatttcttctgctggttctgcttagttctaaggagtaaggtagaattttggtgccatacctaaatatcacgtctaaaatgacattggtagcacttttccaagaataaccagcatattgatcaagccattaataaagcctaattatttgctttaagaatgtttttggttgtttcaaactgagttttttccaaagtcataacaaaactaggagaggctgtagattcttaattattcattagattagggggaaaacgaattgctattacaaagaatatcatgcaaaaaataggttttaaaaaatgcattactactgagttttaaaaatgtatactaacattctccatatcaagaactgtttcatggatggtagattttagttatagcagtactggacttacactcagtcaaataattttaaattttctataattgggaatacatggtagctgaatataagcaaacatattactctatgaaataaatgcataagagtttgttatcacaaaaaacagcataacattatttttttgaaacacaaggctctgttttaacactttaccttgtttaatagtaacaaaacccctgaggaataggttgtattgccattttaaacactggagagcaaaggtccagagaggttaaatagctttctgcaggtcacacagctgatgaattgcagagtcagcatttaaccccggtctgcttttctgcaaagcctctgctcctcactctaccctaccgaccacctaagtatagatcagttaatcttgccttcagaattctcctttcttgtgtacttccatgtacattcatacttacttcacatgatgattctattttctggaagttccaccacatatggcgataatgaaacatctttgtcatttctctaagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtccaa

SEQ ID NO: 2638 - DNA, 44878 bp, Homo sapiens
cctcctctgcccaatgtctcccaatctctttcctttctctcttcagttcctccaggtaattcttactcaaacttgtaccaacttgtttttgactgacagtgaacagtgagagagttttcttcattttgaggaaccctaaacacctatctttcccaaggcaacctgtctggactgagcatttctctgacttgacataacttcccatccagccaggagtctgcactcttcagtctttgcaggtaagaggtacacggcgcttatgttaactctggggcatgtggcacgctggaggtatttttgaaaaactttacttctaaaggtaatgaaagcgttgtgattcttttaaagcttatttaaatcatttaagacgcccgtgcttatctgggggaatttacaagtgctgtttgcatgtggaaaacgggattttacttaatgatgggacaaaaaaaagtgttttattcttgctcgtgaaacaatatccagatgtcgtcttgtttgcggtgggtgtacgggggtctagcttgcgggacaagaattactccgacttctctttgcaagggtctgtcagagcaagtttgttgattttcagcgattacatagttctttggctaattctgaagcagttactttcctttgtcaatggggaaatcagtttagattgccgtaaggcgaaacctcgccggaatattttaaaatctgttacctatccttttgagaaaagttatgtaagttttctgtggtaggtgtaaggaatgtaaacgatcctgagtttggaaatattatgaactttgttcatgacccatgattaatatgttttttaatctgtgtataatttcatgagagtttagactatcctcagctaataaatgttatactgggtgaaatttccacattgctcctgtaacgccaacgtttgtctcctctgtacttccgcatttagtcacttgaaggaaataagaatttattgttcaatagacatttcttgacctcataatttcttttaacccacaggttagaaaacttacaacgaatgtagtatttgactgtggaaaactaaagaccaaaaatgtgtaccattaattcaaatgtttagatttatctttttcccctttacctgtaagagggattttgaaaaaaaaaaaatccaagtgattcttaaaattcattttttgcaacctcaagatcacaagcacacactcacactcatgcacaatcaactgttatccccaatcctatcttcttttgtcctcttgtgaatgtttaaacaaatatgaaacaatcggtagtaatagccttaggtgacaaattctctcctatttaaaattgtcctaaaaatcaaaagaaaagtgtcccataaagctataatacatttttaaatatcatcattttgtgaaaactaaatacagtatcagagacacttccagccgattaattaggtaagtaagcacttacctcacacacagcttccccgggcgctgttctttcttcccataccttctagggttttactttttagcagtttttctccttctctgttaatataataagtgaccatccagggaatggcccagaggccacaaggcaagtcttcccaaaatactgaagattagaagagtttaaccaaattcctggtagcagcatgtcagaaacgctcatcaaataacggaacagacctttcttcactgaattaaataaatgtataaatagtctgggggttttacagaaattgccttagttgaactttgtgattctggttgcttaaggaaaacacatttttctaaaacgtcctctctccatgtttccactccttcctcccaccaacagttgtggtcattttacagaaagtcttatttccccaatttcctctcctcacacttctcaccagtgcagacagccagtgttttggggggaaagagagcgagaccccaggctgcacatgccagcaaacctgagaagccaacaaaagcaggtctctgggctctttcccataaggctcagcacaacctcactctgcttctgcatcgaggaaatctcgaaagggctgtgctttcttggggcgtgtgtgtgtgtgtgtgtgcgcgtgtgtgtggtgtgtgcaattatatacctgaataacaatgacatactcgttataagaaaactcaccaatatgtggctttaggcacggaatagagaggcaaagttattcggatttaatcagtacatgtcaaatctttggaatatcctttcctgtgcaatcccctctcatctgtttagagactcaaagcagcccacgaagttttttgcatactttgcctcagagtccaggattgcttatgaaatgtatttgtgtggtggatgcgtcagagtcttagagccaacataagagtccagagactgagctgtaagcatgataaagctgtcaatgactggcccgtgggaatgcttgttgaaggcatatacacctccctaatcattttcttcagtctttaatatgtaagtgatacagctaccgttatttttttccctgcagcaattcaagcattgcaccccggattaaatcatgtatctctaaatatgttgttttaattctttcaagtaaaaataattccacaccgaaaattgtcagaaagccattacatgagttaatattaacttttatgtctgcaaagatgagtttgttgcttattcatgggcaaatacaagaggcaagtcagacagaggttattgtctaccttctctctcttctgtcctttacctttatctcataaaagccacctcaggagtggggcttttggtgcagctgatggtgggataaggccggggaagtctggatctagaacaaagtgaaccaagggtgagccttattctatgcccctcaaggatgcagtgccctggaaggagacaggtctgactgaacacacctggctcaggtaacttcctggtgccagttttgcagacaggtgaaggagcagtgtgacccggtagtagctccagagacaagcaatctaagaagtgctaaatcttccctaaaagaacacaaggagcctgctcctacctttaaaaggagaactaagggcagagagggagagaaactaagttataatttataaataaaggtttataaacatttaggaaatgcaacttctttcttggatcctttatttataagttctgacttagtttctctccctctatgcccgtgattctccatttaagaagttttatttgctaaatattactctgttgaaatgaaagaaaaaaatgagggggtagatatttctgataaaaaggccaggcgagaaagttgaacttgacaggtgtagcctctggaacacgtctctggatgaattcagatgatagtagggggatctccactcatcgtaatgcagctggaatacacatagtgaattctgtcacatgcccagggagaatttcagtcagaaacatctgtgctgttttcacaagggaaaggtcagaactccatgagtagttcatgtgtctgcatttcttttgatgggcattgtgcctcaactagagaagagatcaataagccaatagccgccactatccaatttgaatccagaagttcacacaacctaattccagaatacagtttgtgcttctagatgaaaaattctaaagcacaagcacacaattccagatattttagccactatacaaagatgaatcagggtcacgtgatcatgctcacgtcagaagatgcaggagaaggacaaagttttgcattttggtacaaaacacgcatgtgccagccacccgattcgtttccagtagggagcagttgagtggaaggtcatgtctgcactaccttaggactgaggacctacagagggaacactggaaagaattagcaacagaataagccaggttctgtttgattctgtctctcccaccctgcagctccaattcagagcagtcttaatgtgcagggatccgcatagaaccagccaagcagggcctctcgtagtagcctgaccagaagtcacagaggctgtgtaggccactcattccctcattcagagttcagacatcctgagcctgcccatgtccctgagattacagataacacgaatcctcagagtcaccgctgggccatcaaagaaaaaagagggtgacgcagagagggaacactgcaggggaggaatgcaattcttagggtgctctgaggacccaggtgcctgggtttgggtttcattcacatcctgcttcagtcggagctgccctggtgttgggcggatggctatggaactcatgtgcattttctttagtgtctacactggaggctgatgaagattttatggacccttaagattgcacaatttgggggctttctttagagaaaacaaatgcaaaattaggactgtactattaagtacaaggatttggataggacctgggcaagtgaggaaccctgaagctgaagtttcattaacttcttgataaatccactctgtgtcatacatagtaaagccctgatacttgtctcttgaatgaatggttgaattaacttatgtaaattttagctgctggctgctctctcaataactctgaaaaatgataagcaaaaaatacctatcatgtttatccatatctagtgatcagtgatatatggaaaaccaatcttaatgctatctagaatgtttcttgtttcattggcaccttgccatgaaaggtaggtccttgtactgtagttgaacctttaggtcatatctcagctcaagggtaagatgctatcaaagctgcttttcctatggtagaatatgtgagtactgaaattaactgtgcgctttttccacctgaaaagcccccaacttaaaacctaaagaacgttatgctagttgtgccactagaccctagaatggtattgaatgcatgaataataagcatcttcctgagcagacttgagggcttgccccagtggaatatctgtgtctttggtgagaagccttcctcttttttccttagtttctattaacgctgtttccaattttcaatagcagttaattgtgtcatttcttggtagaaatgctggctaaacccatgcctaccaagccaaataatgttctcactcaatgatgtttacattttcaaatatttgcagattgatatcttgcttcatcttagacctctttgccaaaaaatacaaggtcagctccctgaatcttgctttcttatttcctgagttatccttcatgtctattccaacctttaaaggacaaatttgaaaagtttatcctctgctttgaaagtttatgaaatttgtcatcatttgtactcttcctaccaacgccattctcacatatctgctaggaggtaaagaaaatataatgaatcctggagcacctggctgctgtgactagcatgctctaaatactaagaaataagaaacctgccctgtcttttttatattgtcagaagtttgtggaaagaatttatatatggacagtgagctgtattacatacagacacaaacatacaagtgacaaaagcagtgtgggtgtgtatttagctaggacattaataacaaaactgactgtgtaggtatagagaggctatcccaatgtcaacaacatcagaatacaatggtactgtattttgaacgtcttgtttaatatatttcaaatctataattttgacttacagtcaaaattaaacattaagtgcacacaaaacaattaccctttaaacagtatttttaaaaagtgatgtcatagtgacattgacatctgacatctttttttttttttgagatggagtcttggtctgtcacccaggctggggtgcagtgatgtgatcttggttcactgcaacctccacctcccgggttcaaagattctcctgccttagtctcccaaatagctggaattacaggcacctgccaccacacctgcctaatttttgtattttcagtagagatggggtttcaccatgttggccaggctggtcttgaactcgtgacctcaggtgatcctcccacctcaacctcccaaagtgctgggattacaggcctgagctaccgtgcctggccgacattgatatcttaacgtcactccttaaaacgagttggatataatgtcaaacgacttgattcttgtcaacaggaatgctgtgataatctgattacggaagactcagggtcttggttcctaggccctagggacagaagaaggctagcttctcccagacaggccaaagctgctttgaggagggaaggggaggtgaagtctccactccattgccagcaggacacacctgcctaggaactgggggagaactctcagaggctgaccctatacttcctgtctctggagtcaggggacaggggtgattctgctggtcagaaggcaggagggagtgtcctgaaacacaattgaatttgacagcaaagcactgtctatcctgggaagttctgctggtgagcggagtcctgtgagggtcctggtaaccctatccctgcaagaaataagaaggtctgcactcaaataggttcagaaaacctttcctagtttaggcccctcttgaatcttcacagcaatcattaacattttaaaaaccccaagaagttctgcagcaaagacgttctttaactttgaatccaagttgtacatccattttggaccgcagaactgtccaccacctcctccctgaccacaactatgattccctcctctgactaacgtttcacacaaccccacgggggatgctttggccaactgtgatgggtgtggagtggcaaggcatcgtgcgatccaaagaacatgtgtgatgtccaggctccatttaggtgtaagttgtactactggggcctgactacctctgcatgtgactggccagccttcgggattgcgaagtggctgcttacagtcagccccaaagaatttttttttactttctttctgtttctttatgtccaccttattcctaaaagaatttaagtgaatttacaaagatacatacacacacacacacacaccatgaaataaaagaggaggaaaataagagtaaatgtcaaaaaggccatttgattaaatcatttacttacataaatttgaactatttttaaaaatcacagttgagtgcacacagatccacagtgccagaatcttacttttgagctcaacattaaatatagatcttaactacatctgaacttaacttagcttcctatttgaacctgggaatcaactgggcactcactgaatgtagttttacacgcactgtattttacaattcttttgaaagacaatgtccattttcctctgtggatcttttaaattttatttcaccttttacacccctttatgtataatttgtttatactgagattgtaaactttcttcattggcttagactcaggtctggcactagcctaagggactaatctctggtccatcaggcctgggctgggaaccctctgtgggattccctccccattcccggagatagctggttcgccctgcttggccccactttacaatggcctgcttacttgtcccttttccctacagggctgcaaactctttgacaatggagattttatgtagttatttctttgtgctttcagggcatggcccaaggtattcttcaagcaatatgtattgaatccacaggcactgacatgaaaggcataatttttgctataattacatctttactttcaccatgaacttacatctacctcatcctgcaaacgcacagcagagacctttttatctgaagtcttttgaaaatatgtgtatgtgaaaatggctaactggtgtgttctctcccttggtgaatattacaaagtgatagattggctgctagaattgcgtaagtggggttattaaggagggagacatcttattaaggagtgacaagaaacagggaaccatgtgcttaagatatagaagttgtgtaaacccaacagaggagaaatagaaaacatgcaggttattttggaaagaagaaaatgaagacacttgaaataaaacagaaaagtaaatacggagccagcagggttcagcatgggagtgtgggctggaagtctgattctgaggaagaaaacaaggggaaaaaataaaagaaagaatatactgcaatcccaggctagaaaggggtgatttgatccatggagcagcaaatgcagaaaacaacaaaattagcatcatttcagtctccttcaaacgctatgtctagatctggcttgtgttagcatacctgtggcaataaaggtatttggctctgaatgtgttttaaattttaaattgaagagaattttctaacatttacccattttaaagatgaaatattataggactaaaacttgtaagggccacttttctgtgattacaatcaagcgaatttcattgcagctgggagcagcctatgccagtatatggcatttcagagtctagggctgcataaggatatgtacatttaaacatgaattgtataattatggatattaacatgtctagtccaatatcctgggaatgttccctaaatgatactttctgcacagcactttgcttagttttcagtatctgaagaaatggtctgacttgctagccctgtggttggtagaaatgtatatttgatgggtttttaaatcaactctcactcagattttgaatagtcaggctttaaccctcagtgatcttcaccaagtatattcttgccaagggcttactctgcaggaggctgggtggtccgtcttatgtcgatttagaagatataagtgacatcaaggactcaaggagcctccaggctgctgctggacagaggtgtggataggaagacatggaggtagagaaacagtaaagaaaaacacccaaagcacaagaaaggctgcagtgtccagcagaatgtgatgacattgacatgagaggccctgacaaagttccagggaaagtcagagagggaaagaccagatccctttgggatgactgtaagaggcactgggacatttgagatgtgccttgcagaacaagacgacttccagggtcaggacggggagaagccttcagagcaggaggagttaccatgcaccagcaggagggtgcgggaggtcggcagtgtgcacaggggctgagcttactgcagggaaagaatgggagagtgagggccacagtcaggacaaagctggcagccaacagtgctgagcactcctgaaaggccaggcagggctctaagtatttctttttgtttgtttgtttgtttattatactttaagttctgggatacatgtgcagaatgtggaggtttgtcacataggtatacacgcgccatggtgatttgctgcacccatcaacccgtcatctacattaggtatttctcctaatgctctccctcctctagcttcccaccctgctgacagtacccagtgtgtgatgttcccctccctatgcccatgtattctcattgttcaattcccacttatgaatgagaatatgcggtgtttggttttctgttcttgtgttagtttgctgagaatgatggtttccagcttcatccatgtccctgcaaaggacatgaacttattttttttatggctgcatagtattccatggtgtatatgtgccacattttgtttatccagtctatcattgatgggcattagggttgattccagggcatttgtgttggttccaagtcgttgctattgtgaacagtgctgcaataagcatatgtgtgcatgtgtctttatagtagagtgatttataatcctttgggtatatacccagtaatgggattgctgggtcaaatggtatttctggttctagatccttccatggctctaagtatttcttaatcctcacacaggcaggctttcttgctaacctctttagagatgaggaaagcagggtgcagaggttaagtaacacgctgaggacacaggcttcagagaggggtgaagctggcctttgaagctaggttgtccatctctagaagccacacccttaagcctctgctgcaggaggtgggagttaaacataggcaatgagaagtcattgaatattttggttttctgggtcctgagctgcactttagaaataccagtctggcagtgatgatcaagtgactaattcaaagggtattttgagagactgagtgaaaggaatgaagacctggaccagcatggtggctgtgggaaggggcaggagagacaccggtgcaagggagattcagcaggtggaatctggggcttgcactgattggatacaggagtacagttgcttaaagagggagaggtgagagaatgaggacgccattgttaggaaacaaaaatcaggagatgtagctggatttagggagaataatatgccttcagttttggatgagtcagttctggactgctctcattccaggagatgttggaaacagagactggatccctgaggagatgctgttagtgagcattgattaacaccatgggactctgaataggcagtagggtaactcagaggatgccaagagagaatagaaagatataataaaggaggatgagcacaagaccttggggaatataattacaaaggatggggaagaagaaaaacccaccacgctgcaggagagtgaactctcagagaggcagatagatgagcaatgagtctgctgacccactggtaaccaacagtaggaactttctgaggaagacacagttaatggcgccacccttgactcatatatcagagaagaggagatggagggagttgaagggaagaaacagtggaataggaaggcttggtagcaccttgccaactcagttcagatgaaaagcctgagagaaactgagagattatcatttggctggcagagcagagttctcagggtcctggaagctggctgtcttcaagcctattaatggttaatgtttctcatgctcttttttgctaaatttgacaaacctattccccttcctcctcaaagtcaactgagttattcactcagttaaatctatcatgacttaaaaagtatatgcttagcttggagagggggttacatctgttcttgtagtcacataattactggagacatgaaggaagattccagcaactcaggcgccttctgaacaggttgaatacctggtttttatgagcaacccgcttcagttttctgagaagctctgagtaactacaactaaacaagtctattcttgaatatgtttataataaaaaaggaaagataatgcagttatttgctaattgctgcaatgattaaagcaagatgtttcaagtttatcctttcataagaccagcagccttttgaacacaaacaggatctgacaaagatagtaataatgaaagcgggagaacaaggaaacaatgccagttttcttcagaacaatcggttgccactgacttctaacctacctacagtttcaagtttctttggctgggactatattctggtttttcagtgctgtactgtgattaagccaaacttcagcaaaaaaggaagtgctgcattgtagcagtattgaaagttatgtaggtggattttttaaaaaaaatattacagcctaaattttcttagcaaaagtcaaatgagtaacaacacacagtttggaaacatttggagaggagaaaacaaatatctgacaagagtacttaaaatctgaaaaaaaaaaaaaaaaaaaaaaaaaaagaaagtgggaggagagtgagaaaaagcccctgacaggtaatggtggaaacctgacaaatggaaggtcattctaatgagagaggcggcctggtctcatggaaagagactttggcctttggaatctgaccttcctggatgtgaattccaggtgtgcagactcctggcagcaatactcttgggaaaggtgcactaatgttctgagcttcaatttcttagtacattatggggcatatgggaaagagacagaggtgggctacttctctctccactccaggatgccaccctcccactgttccccaccttccttcttccccaggaccaggctgagctcaaggcttgtccctaaggcagctggtgaaggaaaggttcgacttggtggtagaagccctggactggagtccccacctatgggctgagggatcctccacaagtgattcaacttcttagtttctcacctacaaaaggcagggaaattcctgccacaggacaacaaggaagttaaatgacatgattttttgtgaaagtgttgtggaaagcacttctgtcttctatcttatgaatcagtagggaatgagcattctcaaaatgaccagaatgattcctaatttcctttctaaggacctgattcccttttcatacgttctttttgttctaaaaacaaaacaaaacaaaacttactttgtaaagaaagcctgaattccagagccagagtctgtccgttaaaaactttcaagctttttttttaaacttataaaaggcgttataccctatagccactcaaacttgtataaacaagagttgcaatgtgaaaaaactcacttgctgggtttgcctctatgaacaactattgttgtcaatgcaaattgaatccgaaattacccttgtcattgtttttttctggggttgcttctttcatttctgttaaaaatacacagaaacattaaaaaagtaactatctcctctgttttataaggagaagaagggataaagaaaaagaaaatcaacttggcatgcaagtgagccttgctctggaatttgggtgggtctaggaaaaagcaccgacctcagtggaaaacatatatgggtgtgtgggaaatccctgtaaactataaattgactacacagtgcttaagctggtgtggagagaaaccacaatactctctgaaaccagagaggaggggacagagagcaagttttgcacgaggagagcacaaagtgtccctgggagacagagctgctggtaattcttagcaggcttaactggatctattgaaagtgaccactgtaaaacaccactgttgcaccctggggttctctgtgggatgcccctacttgtatcatgcaggaaccctatggcctgactctgcttcacccacacttcttcccaccgctccccagcaaggccccccgccctgttcaattgctcctgtatgcttccccacttcactgccattgcctttgcagctccaattcctggaaagcattctttcccttttctattagaatctcattatgtagcttcgaagcccttcaaggcctgtcaagactcagctttcccttcccgatggggccttacctcttctacactttctaaatgttatcttctccaggctgaacaaaacctagtgtgtctctttgctactaaggactaatcagatgctgtgtcctgattcattcggtgttggtgtatcccatatctccaatcagattacgagcccctggagggctgacagcacgttggacttggctgagctagaatcagctcccttttgcaccctgagctgagtgcatgcagctcagcatttgtaatcctagcctaatgcaatgtgaaatttattatctctctttttacaaatgaggaaactgaagatcagggagacagtgtgacttgtccaaagtcactagcccagttgcctttcagaaggcatctcactccatcttcaggatgaccccaggggctaggctttcacactttaactcctcctagaaggtcataacctgaagatctgagatttgaacccaagtctgtctggctcctaccctgtacctttcccactatagcatattgcctccctatcaccaaaatgcccaacacgaagttgaacatggcataatatcaaatgaacttgtgatcatcccgttttgtcaaaactaagagaacataaaaaaaaatcagcaaatttgaccagagcagtgtatttatggcaagaccaaggcaaaacttgattctgcattctttgcattatagtaacagactgaaaaggttcataagtgtattcatatttaagggagtgtgtaactgttctacctgggtcaatgtagaattccctatacgttgcatgcatcatcaggaatttcatatgcagcagataggcatacagcctggtttctccaacagccaaaggcatttctgagtggcaacaacactgatctggtgaagctgagtccatctggacattggggagccccaggccagcagggtttctgctaagtggacctttccaaatcctctcagggacaaaacctggttgggcatcttcaagaaaagatgctcttgtaaagttggtgtagctgcttaaataagccccgaatagagtctagtccgtctctctgtgcttttctttaaatttcccttcatagaaagctaaaacttaaagaggtttcagagaagctagtctgaccccatctcccagtatcattgagaaaactgaagctcggaggggctgggtcatttgccggaggttttgcaggacacagaagagcttgttctcctaatgtggcctagaactcttcaccaggcctcctcctatcccaggtggaaactaaagaggaaaagatgaagccaaactcaggcggaagcaacataattaaactggtttatcgtttggcaacagagatcagaggagtgagtggaaagtgaaaatcagtgaaacacttgcagtttaaaagaggcatgcgattcctgcttttcctaagcagttgaaatgtgtttatatgtctttcctggagctctctcattgctaatgtggtcctataaggggaagtcctggagactgagctgggtgtatttgagtattcttctcaatggaaggcaatgagcttgtgtgctacactgcttaggccacacgatcccccaagcctgggctgccagacgtcgccatcattgttccatgcagatcatgcccatcctgtgcagaaggtcactataggaacacatggcacagggaagaaaacgcccatagaaattcacatggtgcttgtctaaaccgaaggcaggtgagatccacccactgtcatgggaagctgctagcatgctcccatttgtttataataatttctccaccgttagaggctgctttaaaaagaaacggccaaaacctgcgatccggtgccacaattgagacagaaagcatgggaccatgacagttttaagaattactaaagtatgaggcttgaccagatcatttttccaaggatccagagccctttagagagaattcaagagggagaatttctggtgacttctaccacctctgaagaattaaaaaacttacttgtgctgctttccaggcctctgtggtagttaattctgcttggcagtttttgttgtcaaatagcttttaagaaatctggagctatctcagatataaataccttaatgatgccagaggactgtctttcacccataaaaactgaagccatgtgccagaagccctcgtggctcaagggctctgtccttggacacggatgagggcagctgggcggtgggaccgaggctctgcctgaatgctcagcttctgcaagctggggtggagagtgtgttcctgcctaccggctcagccagcacaggagcacgtagcctgcaggtgtgggttgtacacaggcttccccctgctgagtcagttccccagatctcttcatcacttccccagatctctgggatcttcagctgagattgggccccagcacctggactcaaggtaaggccccttaggatgcttgtagctgatcaatcagggtagtgcaaaggaagaggggaaaaagccacccagaccttaaaggagatttctggaagatccaatcaaagtgattcaccttaacctcaggcatgacttttccccattatctgctgtttttaatttcaagtagtataaatcttactgatctgaagaagacttctgcttctgaaactaccagcgcttaacaatgattgagccctactctatgagattgcaaataaaaatatattaaccttggcaggaaatcaactgattaatacttataccctacactctaaagactggaacctcaatttatctgcataaacagaggctttgggtataaaagtaaaatgtagttggttatgccaaagactgctttcaatagtaatgcaccaaacatgcttttgaaaatagcaataaactattcatttaggttagatatacaaataagtaactttcagagttagcactaagttttaagcctcaaagactttgatttcagtgacaagatgtgtaaatgcagcggttagaaaaagtacacatactgaggtttctttcaagattatatatagtattattcaaaagtcttattgtatatgaaaagtgacaagatttttgcaatatgaaacaacagtagctagctaatactctagttacctttacagattgtctagttggtcacattataccttaatttttcaggatccaaccaaggcctggttaactcttactggcaatgtttgaaagggatgaaagaggtcctatgcatattactctaaattaatcttagtgcaggaagacaagtcatatttgaataactttattttgtatccctagctactgtcatcctagtatttgaaaagctccttttctcccaatgttcagaaagtcattttccaaacttgcaaatattaaaacctattcatgtctaatacttttctacttggtctatttccatgtcctgtcaatgacctatcaattaccctattcaattacccatgtcacttgagatttctcccaccagaatttaggttgcatattttcacagggcaatttattttaaaatcagaatggtccataaaactaatagctttgtgtgcacagacctaaaagatttgtagtagctctgcagctgcatttttgaacatcaatagttaaacgatcaacataaatgttaaagaagtaaattaactttcagaatttcacgtgtgctctagcattcaccattgaccatgctggaagaagactttgaggtcatttcatccaaccctctcattttacagatgaggaaaacaggactaattgatagctagcaatactaaattatagctcttctaaaactagacagcagcgtcagtaggcttcttcatgtgctcaattactgtatggattccacgagttgatgagcgtgctgtgaccttgagcatttacattctgtggttttcaaatgtttatgtttctaatgtggtatttgtaaacctgggccccagtaacctttaccactgaggctttgccaatcccaactctgggcagcccacctcttccatatgcagcagtgcttgcaggctgttccgcctgggcaaagtcatgttaggtgtaagcaaagacgtgaactagtgttcatgcttgaaaacctcacagagacctgcctgctggctgaatcctttcttcatctcttgttgcctctcctacatgtgactcaaaagctagccaagtttgttccacatccttcagcttgttcctcttacaccaaagtgccataccatcatcccctttagtaagatcacacttctccaatttctgtcctcctctactcctcaataaacaggaagatgctgtctgtggaaaatgcacgtggagctcttgcacacgttttctataacttgtcttccttccacttccccacaactagaatataagcctcatgagagcaaatgccttgtctggactgttatctcccctgtgtctagtatagtcaaaaatagtaggtgatgggtaaatacatgtgcaataaatatatcctttcatctttccttcctatcttagggaaacaaatgtccctttcttttctgtcttacctccctaataacatcagtacttctttgtccctcctccaatattgacctctgaatcacgtcctccttcttgaaatcttgccttcttaattgtctgcttttattaatttacataggtgtccagccatctggctggcctttctccagttcttttgctggaaaatcctctcctcttctctttaatacaggcagcctctaagattgccccttcagttgctttcttcccttggtatttttcttttttttgcagttctcattgactcatatctggtcaacttttacctctaggtacaatgattcttcaatttccacctccagccccaaatttaattcctagatatggacatgcttggagccaacaccaccatgtcacctcaatacactctgcttttcatccaaatcttcctttccatccaggcagcaaactccagagtcctttccactcctgttcaacctttctacttcacatatgacaggtgtgtgaattttacctggtggcaaaccaacgtggtgattctcttgaattcatgtattacttagacaaattcaacagcctcctaaatgatctccttctagctgctctcctccctctccatctgtcttgctagatgagcctggcttcttttttcctgcagaaagatcaaacttttcagtttaacccgcatcaccttttaaaattcattgccagtgtagttcccaatatggcctcatactaacttcagataccccagtgtatctgaagaaagtaatcccagctacttgggaggctgaggcatgagaattgcttgaaccggggaggcagaggttgcagtgagccaagatcactccactgcactccagcctgggcgacagaccgaaactccgtcaaaaaaaaaaaaaaaaaaaaaagcaaaaagcaaatgggaaacttttttttgaaaagatcagaggctccctttttaaaagagcagagctcaggctcttactcacatccctgtgccccaccaaaatattctgattttattgtcctgtgtcagagccaaggcattagttcattttaaaatccccctaggtgaatctcataggcagccatggttgaaagtcgctgataattgataaaccctatggcccaatcaattgggagtacttgaaacatactttgccaccccatagttttgcctgggcaattccccttgtctgtaatcttctttctcctatttttttttcctacagaaaacacatgataacttctttgatttttccagttagaaggaatcagtcctcctcctggaaatccttaataccttttaatatatcatattcattcatgtgatctaggcagaccttgtgttagatatggacaaaatggagagaaataagacaaggtccttgtctttaagcagcttacagtcttgccagctcactggttacacatgaactagtgagtatcaacttttatgatagaagtgtccatgggatactgttaaggcatgaaggagcctattctgcttggcatgataacaatttatgtatatgtcatctcttatatcaaatggtatactttcgagggctaagatcatgcatctctcacctttacgtatttcaaagaccacagtagtataaaatgtttgctgaataaatgagcaaatgaatgatgttttggtaattaggagtcactggggaataatggcagctcttaggaaatggtaccatagttccattcttggggtagggctgggcgtgtccccatggagttcacagaactatgtcataatttcagtactaaattatgtgtgttttacagtttctctcaatcacccattctatgttttatttaaaatggtaataggaatagcatgttagaaactgggtcctgtactcattaacaaaaagaagggagcaacagacattggggtctacttgagggtggagggtgagaggaaggagaagcagaaaagagaactattgggcactgggcttaatacctgggtgttgaaataacctttacaactaacccccatgacacaagtttatcaatgtgacaaaccttcataccctttttttggtaccccgaacctaaaataaaagtttaaaaaattatattttagaatatattcaaaaagtaggatattatttctcaaagaaaacatctgaattcatactttaaaaatattttttaaaacttgaagtttgatcaaggcatttacatcctaggagacaaaagcaatcatttcagtatgcattctagatttatcaactgcatacatattttaggaagattttaagatatttcaatataatatctaaaaatgaccacttaattttagtaaaaagagactcccaccttctggtaattgacaattactatggtctgagagtgtttagattaaaaaattgtgtgtgtgtgtgtgtgtgtaaaattatcacaggaaaatcaatacatcaatagtagcaccaaaaaagaaaaaaaaaaggaaagaaactaggtcctatttttcatgactaagaagttgacaatggtctttccaaattaagactcggcatctttgatttttgtaaacatatcctggagatcgaatgtgaacatttgatggctgatgggaagaattgaggaggattaggggagcacttgactttgccatgattctcaagttaaatccttggacctcttaaagatgttgttgatgaagctgctaaaatggtcaccagatgaatataaacaagtaggacccgcagtaatttccaggctaattttgtgcacgtgcgtttaggggcgagtcaaattaaatgaatgaggagctgatgttcatgtgaaagtaattactctcctccagtagaaatcctaatcctacaagtaactgcagaaataattaatcataactaagaagcaaaccactctcagggagaaaagctgtatctgaacttccacgtgctcttggaggatacgggtgattcacggcataagagtcatctaccaagtcatctgcaagagcgagtgcagcttccaagagggtctgagtcagaacagataaaaggaagttcttcttaactcagaagatttcaacactggggaagctcatttcccacagagatagaaaaatgtgcactataaatcactctcaaaaagcaatttagacaactacacaggtaatgataaatgcatggagagcactcacatgttttgggttgtgtttttgaccttcattcattctttatagattattaatccacggattaagtcattgactcatttatagtcatgagtcattaaaacttttctggagcatctaccacatgccagcaactgtgctacttagggtacaaaggtggacatggcccaacccctgccctcaaagaacttctagggaacactgactttgcaggcatgattccgtctgcatcacgcatcagtaaacagctatgtgtactgtagggtattgagacacaatgacgttccctctgctcagctcatcaccacaaccaatgtgtaggagcttgctttttgagacccagcggtgctttctataactggaagattccaagtttcctttgcttccatttatgcattcagcagacattaaggccctgctagaacctaggcattggcatgtacaagatgagatatggcagcttgcattccagtggaaggtggtggggtgtgatggatgaagagctggcttttgagtcagactacaatcttaaacattgtcgccactactagctagttgtgtgaccctaggcaaatgctttaacttatctagcctccatttacttatttttaccagcattactctgaagtgtggagttatacatacatgagctgccgacacagtactagttacatattcattctcaactagtggcagttgttggttggatcattattataattaaatatacacaagcaaaacagatatctctagtacactgagataaatattctgggagacagaagcataggcaatcatgtagagaaagccccaaacccatgggaacaggtggagaaagcacctacctagaaagggtaacaccccaaaggatagacatgagaacgctggccaagacaggaggtgggctttcgggcagatggcatggcatcaagtcaatcaatagaggactaatccatctgggcaactgcaagtcattctgcatgacctgaccaggtaacaacctaaggagtggctggcactaaggcaggtggggccagtttctgaagggtcagtttcaggagctgaggctttggtttgtagacaatggggccactaagctgggcggcagagtgctttagggacaccactgaggagggactatgaaggatgctatagagagaggacaacttgagatggggacctcaattatgagcctgtgctgtcatgcaagaaataaagtatgtggatctaaaccaaggcagtgtcacccaagaaagaaaatgtgtggatctaaaccaacgcagtgacagtgggaagggagaaaatggacagcttcaagggatgttggggtagactcggggtgctgagtatttttcagtgcctgagggtctacgggaggaagggagttgccctgggtaatggataatgaagctaggctgggtctaatttggggtgtttgtgggcaatcaaagggaggaaccacacacagttgactgttgttctggcagtcttgcaagagcaatctggaacacaaaaagtctaggcttcatgaactacaaaggtaacatctgaaaccatgggagtagatgcaggagtgtgtctttagtgaaaataaaatagttggagcatggagccttggagaaaatgccacttcaagattggcagaagaggaagaacctacagatggaactgagaaggcatcagaaaagtagaggtcaagttgagagaagagagtagcagcagactgaaatgctatggaaatatcaaggaagataaggaatgaaatgtatttgccagctgagttgtaagtaactctgaccaagtggagtggtgagctgagaggttactctcttggttgaagagtaatcacccagccctcaaggaagtggaagcaaagtatcgcttctgtcctttttaaagctcttctccatatcattgactctgctccccaaagcttggcttttagtgaaagccattctatttagacaaactcattgtctctcctctcaaccccaagacaagcattttgatctctttaactccatgggttttattaccaatgaatgaaataggacatggcacacagagcagacagaaggccattgccaaggtctttcaactggggtcccactctcaattttacttcctgaaagttcaatgtcttggctgaaaacagggctgaagatagatccaaggaagaccactgggaattggccaactaggtttaaactggggaacaactcccctcaagtggcaattttaagggtcttcatcctgcctcattggctttaatccctcttgaacatgtcaaagtggttggaagactgagtcctggtgggccacattgtgtttctgtggactgcggactagtttcagaggaagcacctgtctaacttaaccagggatcacttaggatgaacaccagttacacagtatagaagacataaatatttgaaattttatttgcagccactgttgcacagtgcaagctgtctcagaaattaaggcatatatatagttcaaatgggaccaaagtagtcttttggaagtcataatagggcacacatacatgaattgttgagcagaccttgtaaattaagagattcattgtattcaggcaatagtgtgtgggtgtgtgttcgctttctttgggaaaacagcatttgtaagccactcactcccaacatcaggggcacgtcagggtgagggtatatagaggtagctgttattagtgagaatataagcgacgcctgacttagcactctgttactgttagcactaccgaatctttgatgactaggtgtggtcaaaatcttggtttccagctatgtttcccataaatgaagtttccagatataagccaaatgcttaaacaaaattgctgactacaggatcattttgtaatactgtatgggtgatttataagctgtgtttttttaaagaatgaagtcatctagtggctttgaactttctccccataggtgaagttataagtccagcaagctcctcagtggctcctttctcaacagtcatgtgagagaagccagcctcaattaagccccacggcattcactgatggaataaattaccttctattgtatatgtctagagtgatgcttgctataaccatccatggaagaaatgagaacacagtcactcaaaccattttctgggttcagtaccgtgttgtccagatgaggaacagtggctgcaaaaggccgtttgctatgcagagtgtgagctttcacctccagcctcagcctcgcctgggagctggttagaaatgcaaattctcagacctactgcagaccttttgaataataatttgcatttaaatgagccctcagggaattcgtatgcaagtttaatcagtattggtgtgaagcaatggattcaaaaattatagcctctcgcagcacacacaaggatacttagggacatacatgcacaatatatacatttttcgtcttgctctaacaaattacatatattttatttatttttttcaacttttattataggtatggggtacatgtgcaggtttattaaacaagaatattgcatgatgccgaggtttggtgtataaatcctgtcgtgcaggtagtgagcacagtacctgacaggtagtttttaaaaccaccccacagccctctagtagtctgcagtgtctattgttcccatatttatctccatgtgtgctcagtgtttagctccttctattataagtgagaacatatggtatttggttttctgttcctgcattaatttgcttaggataatggtctccagctccatccatgttgctgcaaagaacatgatttaattcttttttatggctgcatagtattctgcggtatatttgtacaaaattttctttatccattctacatttatgggcacctggcttgatgccatgtatttgctctagtgaatagtgcagaggtgaacatacaaatgcatgtgtcttttggtagaatgatatagtttcctttgggaatacacccagtaatgggattgctgggtcaaatgacagctctgttttaagttcttttagaaatctccagactgctttccacagtggctggactaatttacatttccatcaatagtgtagaaactttccctttctttgcagccttggccagcaactattttttgactttttagtaatagccattctgactggtgtgagatgataactcttcgtggttttgatatgcatttctctagtgattagtgatgctgagcattttttcaagtttgttgactgtttgtatatcttcttttgagaagtgtcggttcatttcctttgcccattttttttaaatggagcaatatgttttttgcttgttgatttattcaagttcaccatggattcattttaaaatatgtataagatataaacacttaaaaggataaagtggaagctacaattgaatacttctatcattttgtcactgtccctgcttgggttactggtgtaccccacattggagacatctggtgtaaagaagcaaacagagccgaaaggaatcttagaactctttgtctatgatggtcagtgtactggggaacatgaaatacacagaggaagtaatttgttggatgaaattgaatatacttatgtttgcccatagtttttatcggttttgtcattttgagagatgtacaactaattttctcttcaagatagaacattgtggcatattctttgtgctacgaatcagaataggaagacgaaatctttatttctaattgaattgttcaaatcagtgaaatattcttcacccgaacaatgtgcctagctgtggactggattcctctctgggattcctctctgacctagaacgttgggcatcataaccttaggcaagtgacattcttactaaatcggacgctgagtccccttgaatggcatctctgcccaccgtgtgcctcccttaaacattaagttcctaccacatgccaggccttgtgtttgccactcaggatgaactactgtgcccagtctatggggaaagctaaactccaagactgatcattacagcagcacagtaagtattatcatgaggtgtggacaatgagaaggcagaagagaggaacaaggtgaacgctacctgcatgctggaggagatgacatttgagcggggcctcgagggatgcgtaggagtttaccaggcatagagcaaagaagaaatatggaataaaggggtcagcctaagcaaaggtatagggcaggatatctgctttatcagcagtatctctgggtgaagtgcaaactcttctaattcagtcaatgaaatgaagccttaagatgactgaaaactaggttcttggatttgtgcaatagatatttggaaatatctctgagagtaaatgatttcataatgtttggccacaacactgtgtggaaagtttctttgtgtaatataatacagaaagtacttctcatttacagtaaaatctggaatacttggaaatggtctgtgctagggaaactgaattttcagattaactgcataaaaatggaaaatctggttgaaaaaccttcctaattttgttttcctttagagagataactgctgttaatattttagaggtgttttattttgatcttacctagagagagaaacagagagattaccctgcatatttagctgtatcaattgccttttaaaaaacatatttagcattttttcatgatttttaaacactgcataatatttcagcctatgagtgttttataaatttaaaaccattcctatattgttggtgactcagattgcttctaatgttttaatatcataataaatatagagaacactcttgtacattatcctatcatacatttcctattaagtcttaaaagtagacttactgactcaagcagtctaacataaatagtttaaaactttgagtatacattgtcaaattactgcctccctcaaaaaagttatgctagattactctatcggacaccatgcaggaagctcttcatttctgcaaactcgtcaatgtagaatgttcacatgtcttttaaaattttcggtaatttgataagtgaaaagtgaattcctggtgcctttgtgtttcttggactgatggtccctcctcagtctcctttgcctgtatctctgactctgcctggtcttaaggctactcaggctcagtctgggttgctgcttccacactactgtctaagggggaagctcctgcactttcatggctcaaattccactcgttggcttatgtgctaaaggcatccctcctgtccaggtgtctctgttgaaggccaggcccatctgcacagaccctagtgcttacttctctttaggtgtctccaggcagcctccagtgcacaccttcaaacctgcaccccagaggtgagatcctccttctgcatcgggattctgcacaagcgtgagctccatgctggtataacacccaaacattcaatctgggtgtcccataacatgtgcataatgttaaaattacagaggaagatccagtgtcctctgaatcagtaagatagcctccgcccaccccaacacacctcatttccatgccaggaagcctggagtcatcggtgagacttcctcttctctctgccttgtcttcttaacatccacctgttggagacgcctgttgactctgtctgggacctgtcactcagagctcctggctagtagctctcaagctacaaacaccgcccttgtccatgcatcagtaatttcaactcagattactgaaagtgccgattaaacagactctcagcatctatgtttgactctttccaatacattccctatgctgcgtttaacatgatcactttcaaaagcaagtttgatcctttctcttccttgaataaaaccccaagatactccttgtgctccaaggatgggggtgacggtcctcaaggagcccacaaagccacatgcaggggcatggcatggctctgcccttgctcctacctgacactgcttccctctcgcctactcaatatcctcctcgtttcctggaaggtgccaagctccatgctccaactccagactaggacatgttatataccccatgtgctagtctctcatctatccttgactttctccccagttcttcccacaaatgtctttaaatcactcatctaatgatgtatttaatgcctcttttccctgttttcttgcaaactacccaagagcaaaaaccaagtcactcttaatgcttcatcagcagcatcctgtgccatgcttagcacatagttggtgctcaataaattcttgccacacaaaccaataaataaatgttaaagtgttgaaatgtcttttcaccttttcaacattttttgaattgcgtttctacacacgttgcccacttacgagaatgaaggctcttgttgatttgtgaaaactttatatgaaccctctgctgttcatccgtggtaaatgtgattccttttgataagtcgtattttatgttttatttgtcgtatgcatatgacaataacagttaacacttgtgtaatgattaatactaatcattatactaatcatacgagcaggcagagttttatggtgctttatatgtttttatttcacgtgaccctatgaggcatagaaatgatcatcatcgccattctgcatatgaggaaaccgagtctcaaaggggttaagaaagttgtccaaagtcacacagctggtgttaacagaagcagggtcctgtgctcttaatctttacgctatactgcctctgaagaattgtttaattttttttaagtacagaagagataatgttcaacctgacttttgaaggacaggtgggagttaaccaagaaagggagaaaatgaagaaccttcaggaaggaattcatgtgccagatgtgggctgagagggcacccagctgctcaggaaggggcaagtatatacccaggctctgttctgaggtgaataaagccagagagggagcgagagccagggcttaagggtctttttggttttccaagttgttcaggatttgtcttgtcagcagtgggagataccggaggatttatgaaagggagtattgtctcaattagtactctagatgagtaagctttgtctttcctggtaagaattatcttgaaaccatggcaatataaagttgcatgtgactgagtggtatattaactgtaaaaatccaccttcctggctgggcgcggtggttcatgcctgtaatcccagcactttgggaggccgaggcgggcggatcacgaggtcaggagattgagaccatcctggctaacacggtgaaacctcgtctctactaaaaatacaaaatattagctgggcgtggtggcgggtgcctgtagtcccagctacttgggaggctgaggcagaagaatggcatgaacctgggaggcggagcttgtagtgagctgagatcatgccactgcactccagcccaggtgacagagcgagactccgtctcaaacaaaaaaacaaaaacaaaaacaaacaaacaaacaaaaatccaccttcctacttccgagaagtgctacagtaaggctatgaagaccaagcattatgtatgtatctgagctgttttctgttatttccccctctgtttttatgtcagaagaaactgtaccattacttctagagtagaagatgttggaatgtctcctcattggtcttactgttccaatcacgtgagcaccaatgtaatgttcattactaacattagtgcctgcaagaatatcctactggaaagggaattagctgtgattttgttaagtgtccagccaattttcataaaagacacagtatctgagatggctgttaaacatgtcaagagattgtgtacgaggggaataaatcaaggaagactctataggttggtctgattctgtgatattaccagaattactggtaatatctacagcatttagaaacttcatccacagtcagatttaatcccagggctatgaagcctggagaatatatgggtagaactcaggagaatccacgatctcacatgaggagaaaagaacagcagtttattttagatggcctctaactaaaatttgtattgagtgtgtgcagcaaaccacagatgtactagctgcaactgtgactttgtcatagtggaaatcacagacatttcaatatcacattccagtcatttcagagaccttgaaataacattgctgctcaccacaccttcaaaacattagctctgatttaatgcttggaaaagtataattttgttttttcagtactgtaataggtgcattttaatatcattggtgtcttctgtaatctttgtgactttacttttatctgtttaaacactttattctgagaaggcaggcatgtgtctcactagtccaccaaaaaagaccataacataaaatgttaagagcccctgagctaatatcttaaaaatgagacaaacttcttagcttttctgacacctctggtaagccatgcatgaaaaggctgcacccccatcccgcagtggttagatttgttttcagagtttttagtactgggaaaatctggattgttttttttcttctaagaaggatggctttacgttaaaccctgtctttaagtttcttggccttaggaatgactcttgagcataagtttgcttttccctagggatgccagatttagcagatttagcaaatacaaatgtaaggccactctgtactatgcaaatctatagatacatatatgtaaatagtacatatgtatctctgaatttcaaataaacaatgaataattttagtataagcatatagcaaatatagcatgtgacaggcttatactaaattatttgctgtccatctgaaattcaaattcaactgggcatcttgtattttatctggcaactctaaaaacaccaaatttgggccaatagtcctccggctaattaactacagatggttagaatgtgttttcttacactgtacagtgatggaaattagttaactgccaaatgtcttaatttttgattgaatgtgaagatatttttaagtttgaaattttgtattatcattcagtgatcacagagtctgctttcaactttgggacaagcaaacaactgagaaatactaccagtctttaaagcaaattttggtataaactgtgttccactgcgatacagtttctatatcagagaaatgtggtcaaaatgtagactgatagtgagacagaatttcaaaactttttgacatttgtcccattgttaaataacttgtttttttctttgttttttttttttttttttttttttttttgagatggagtctcactctgttgcccaggctggagtgcagtggtgctatctcagctcactgcaagctccacttcccgggttcacgccattctcctgcctcagcctcccgagcagctgggactacaggcacctgccaccacgcccggctaattttctgtattttttagtagagacagggtttcaccgtgttagccaggatggtctcgatctcctgaccttgtgatccgcctgcctcggcgtcccaaagtgctgggattacaggcatgagccaccgcgcccagccataatttggttttaaatcaagcacaagtcgtaatttccattgcctgggatgagattcatgctaataactaatatgaatgccaatgaagataagaattttacctttgcatgcaggtgaattacatcagagcccattagtcatcaatttgtagagactgacaactccacatttatttcaaataaaagaaaatgtagtagtcagcatgaggccagaaaacaagccagcctgaaattgttacccatatttataaaacatactttctatgtttccgtgccttcatcgtagtgcaaaatattataaatgtgaggcaaagaaagataaatgtgagtggtaaaaattggcagactcaacatcttagtgagagagatagatttacttaagggaaagtcagtttggaagtattgtaaattatataatgatatggcataaaaaggcatgatccagtctcaagcatcttcttatgtctcacagaaacaggagttaagaaaaccagcatcactgcttacttcccacgtgtcatctcctgtgaatgctccaaccatgtccactttgaagtttcattaaataaaacacattaagccgggcgcggtggctcacgcctgtaatctcatcactttgggaggcggaggcaggcagatcacttgaggtcaggagttcgagagcctggccaacatggttaaaccccatctctattaaaaatacataaattagccgggtatggtggtgcatgcctataatcccagctcctcgggaggttgaggcacgagaatcatttgaacccaggaggctgaggttgcagtgagctgagatcgcaccattgcactctccagcctcggcaacagagcaagactgtctcaaaaaaaaaaaaaaaaaaaaaaggtcaaatacttgcttctctaccagtattatctgcaaaaacagaagccttccactctgatttataccacagtcagacaaacccaaacgctgtggatttccttctccttaaccaaatggtactgttttgagccatcttctcctctgttgtaggtttggactaatccagacaaaaatagtgagtgagattccactagcctgttgaagaaatctctttcctaaggagaaaattgggaccaggagcagtggctcacacctgtaatcccagcactttgggaggtcgaggcaggtggatcacttgaggtcaggagttcaagaccagcctggccaacatggtgaaaccccatctctactaaaaatacaaaaattagctgggtgtggtggtgcacacctgtaatcccagctacttaggaagctaaggaaggagaatcgcttgaatctgggaggcaggggttgcagggagctgagattgtgccactccactccagcctgggcgacagagacagactccatctcaaaaaagaaaaaaagaaaattgagcagtgcattacggaggctgacacagtacaattcgcctcctcaccccctccacactcacttccagacatcagtgttcctgttttgccagtcatctcacaacaatgcatgtccaagccacgctgtgattagagggagaatatgcttattacccaagttcttcgcatgttggagcagggagaggccaagggtggtaaaccacaggaaatttccatttgccctccgctgcggcactctcactctatagggaagttagttgttattaggtaataatgttcagcggaggttggtcactcgtaacaacagacagatgtgtaatgttttatttgggttagccagctctctcacaaataaagggcctgaaattaaactgtctttatgaaaatattcagtaaatgatacctctggcttattccagtgctcagattctttgccatggaaaatggcaaatgagtcccctgttgggcccggaatctgtttaaacttgtctttgtcgagtacagaagggttgatgttctatgagattaaaaaaaagtttttaaagaattcgcatcgaggagtaaagggaacaacgatgcaaaccacatttagagatggaaaagaattttttttagtacttatggaatttcaaacaataataatggaacagaaacataggaaaaaagctacatatctgaccacagaggcaaattgcattattacatgctcacatgcaatgcaaatgtggattggtctgtaaaggaacactttttgcttttctaatgtatagtagggtgagaggagcacctctccaatttgccaaggcatcactagcaaactccagctaccgaattgcttggggaaattgagttcttttgaagacaggttcttgggaactgtaccccaagaacttctggttaagtagctcaggtgtggagcctgagagcctgcatttctgacgatggagatgctgcggttggatgaggggagaagggtcacactattctataccaccctgtttccagtagccagtgagatggataactcatctcaacatagagtgtgaccacgaagagagatacctacccgtaaaatggactaagattcacaaaagcttgtttccagctctaaccttgttactggctcagtaaccttgaacaagttactcaaactttttgatccttttatctccctagatataaagtgtagagtttagaccagatcagcactcctcagtgttctcaaatgtcataaaaaggctaaacacacacacacacacacacacacacacacgtatatatagctacagttaagcaggttttataactgtaggacgtctcagaaactgtaataaacaaatgtgcaatgtggctctccaaagagtgaaaacaatggggtgtctgggggctcagcttcagctccagtaggcaaatccttccaaaagtatttaaccacaaattcctttatgtgtatggaacacctgaatcacacacttcagcaagagaacccctaatgtcctccagccttaactttcccatcctagaatctaggttctccccacagtcctccaatgttcccagccaggccaatgctaaaagcttcccttaatgatacccattatccaaggaagaaacctgagagcaattttctactacctgtttgcttttttccagcaattctcaactttttgccaagacattacacccgaatttctatccccaaggaaacattttctaactaaaaactccacctggccactgcagtacttatatatttaatcccaatgactttctccattcctttgtttgaaagtaatgagactaaattttagacaatctaatttcttggcttattcattttctccatattccagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggtaggacccagtcatttgcatttttatcaacccctccaggtgattctaaagcacactgaagttagagacacagtgttgagatcagaagcatggactatggattccaacataccttgtgctatatcacagttcctttgtctgaaatatgggaataatattagtacttacttcagagtctatgtgagaattaaattaatatataatacctaatatcaggcctggcacagggtgagcaatgagtcaattaattacagctgcttaatctataatggatgctgacgcgtagtgagcaggaacttagctttgtcacactgcaccacgagactcctttgcaagctaatgctgatgatggtggttagataggagtgcagccgtgggagcagacagagctggtttgctcaccaggtgctccatgtattagctttgtgaatgcatgtaaattatttaatttctctaagcttagtttcgtcacctagaaaatagagaaaataatttctccccaaggtaaagagagggattcaataagataatatctataactgctttgaaaagtgcctggacccttttaagttgtcccttcccaaatgaaagctatcaatgacctaatgacagtggtacctgggcggcccagtgtgtctatgtgattacagatcctgaggccactaggtccttaaacttgggcttcttgctccacaaaatattagaatgataggatatgatacccttacaactttccctaaaaagctatcttgtcatgataaatgtaaatattgactcagaagtaatcaaaagataattagtcaccttttctatgttgttcttagggataaggcaagccattcttgccattacaatcttgttgaatttgggttctttttgtattcagtgttgagtcatagaccaacattcagagtttacattaagactatttcacaactcagttgggtgcagtggctctcaactgtaatcccggcactttgggaggctgaggtgagcagatcacctgaggtcaggagttccagaccaagctggccaacatggtgaaaccccatctctactaaaaatacaaaaattagccaggcgtaatggcgggtgcctgtaatcccagctgcttggaaggctgaggcaggagagtcgcttgaacccaggaggcagagattgcagtgagccaagattgtgccactgcactccagcctgcgtgacagagtgagatgctgtctcaaaaaaaaaaaaaaaaaggaatatttcagaactttatatctttcctttaaatgcagtaccttttaggtcaggcatataatcctaagataaaaaaatatgtattaatcgtgaaaatgtctctgtggtcaggtttcactaggttttgccttgttaacaactctaagaactgtgtggcttacagcaacaagaattttttctcacctgtgtttcaagtcagctgtagttgaattatggctcagttccaagtttccttcttcccacttaccagaaggaaggaacagcccaatccatgacccacccacatgcaaggcaagccatgtgatgatcccgacacctctcttcaggcatggtgtgggttactgctgttcacactccattggccaaagcaggtgacagggccacacctgacacaagggagtaggaaacacacaccccacccccgctacgcccgggcagggaaagtcccagtgaaggatcctttgtggaaggacccagccgagaggcacagcaaatagttgggagcaacatacatcaaccacaacctcccaaattgtcacagctctaccaatagtttccaagttcaaacacatcttccaaacacaggtcactgagaggaaactagcttccaagtgtgctgtaatctcaactggtgcttcccctgaaatcctgataattcccctggaggagaatgagtgattcttcagcctccaaggagctgtcattctttctgggccatccttcagtcctcagtagtctaaggaaaaagtgcttttgcagaaggaaagtagaatttcctcaggagatacaaaccgaaggattgccctctggaatctgctgagaatccactttgtccaccttgcttgttttcaatgaacatgtctgtttctgaggccacttggcaaagctatctgtgcccttggctggtatggatgagttaaaagctggactttgtacagtcagaccagcctttaaagcggatccttcactgctgcgtagtgtagggaggaaaatggcccaaggccaaggccaaaggtcatggtgcatgtgctcctgtgaccacagtcgagggagcccagggaggagagctaagcctttattctcaattgttttaagcctcctgagctcagtgaaccccaagtagattcttgtcaagcattttttttctacttaatatttaaaacggtgatacttaaagtcaaatttaatccaggcattttttatttctggacaaagagatcattgaaaaattaatttgtcagaaatatatgacacgcaaaaaagcaaaaagctttttaagtaacttttcttacaaacaggaagctatgttttttcagagcttaaaagtgagatccaccacaagttaattttagtctagaaatccaaagttactatttgatttagatttcactctttatgcctcatcaccctggttaaaagacgtggaatgagctcgctgaaggcctagttgaggaaccccggttctggggagccactgtctccccatttttctgtaagtgagaaatgttttttctaaggggcctttgctttgttagttcactgtgaaacgcagaatgaagttttctcgagatgggcaaattgaaaatcttcaaaatctggcctaacagagctctaagttttaaagacatcaatgtctttaaacattgccatcatcaacatggcaatgggtactacccttccatttcccattatccttgctgtgtccccaacactggaagtgtagttctccatatagctaagtacctttttcaatgtgccttctgttccattctgtttcagagtgtgtttattttctttcctttaacttcagaaaactaatgctcacagcataagcactcagtgacctcagaccattaatcttttactggtttgaagtaggagaaagtaatactgacctatccattcaatagttgtaagaacttcacttaggtagatatcgccattctaaaaattgcaaccccaacccacaaactgaaacgatataacaaaaactgcagaaataaacattatttccagaaattaaagaaaactgttaatggtttatatgaaatattgcttagctgggaggattaacccttttctcatttgccctgagaatactcactggcagcacttgaggctgcaatatttacctggagatgattttgccacacagtatattacttttattattattttcatatcactctagtatatcaactttggaaacaaaagacaacattctatttagagcattctgcttttagtagtggtatttttatttacaaaatatagtaattcttgatcgctgaaaatgtcaaatcctggaaaacacagcattcctacacatggtgttaacattggtctccaacagttgttggccagagattcatttgatgaatccaatttttccgaaatagacaattctgatgattcagatgattctgatgttagttctgtttagaaataactccaagaacaatttttatgttttactttcacattgaaaatcaatcagatttgcttcagcctcgaaaagcatgtttatgtaaaattaagtgagtactggtggcaagctgcacttttttttttaatgggaaaaaggttaagataggggaaattagaagaaactattcttctctcattctttgtgtttttatcttttggaaaactgttattgttgcttaccatgttagaagttaagccaggtctattgaagaatcactaagggaatataacctaaggcagtaacataaaattatatgaaataagagtatgtatcaacactgattcaaacttcatgaaagaagtctgctgaggaataaaattctataaattaagagcctatgatgaagtgcaattcataaagcctatgggtaagattgatgggcacaaagaagattctgggtcttaatagagcaatgacaaagaggtcatttgccaaacatgctgtggccacactggcaggatccagcctgtaagaggatgcacaggttaattgggaatactttaactataagagagtaataactgtaaataattggcagatcagaagaaacgtaggaagtataagtgtgcctgtgtgtgtgtgagagacataaaaatatatggatgtagacagatggatgattgatagatagatacagatcatagataattgataggtaatagatcaataattgacagatgatagataatatgcaggtagatatttagaccggtaataaatagatagataattgatagataatagattgattggtgatatataataaatgatagattagagagataattgatagataatagattgatagaagatagataatagataggcagatagcttaggaagaattattttcaaaaagtacatgcaaaagaacctcttgaatttaaaggagattacatgaaactgtggatgtttaaggggattttgtggtggactgacaggaaccctgggctagcttccaaagactttggaccttgttctttctgccaggacccagctgtgtcaagtgggatggttctgacaatcttttccactctaatgtcctatgactcaacagtagcaatgcatttccacaggcggtaaaaatattctagactcttcccttccagcgctcactgtttacttcctctgcacttccccttcctgcctccccgtgtgccggtcagttcatagcgggcctcaatgagggtgggttaaccctctctttccagggtgttttgctacggagctccctccaggggctgggaactgtgtggtgagggctgtggttggggttcagcttccttcttaaatcgttccttgaacctttaccctattctgtgcactgtgccgatttccagggattggaaggtaaatgccactgcgtaactcttagaaaatcatcgggggtcagttttactggggtgcacttggtaaccatctatgaatccatgtgtccctctttctttcaggcagtagcagaatcccatggtagccaggtgggtgaaggggagcgaggacgttctacctgccttgaagaagacacctgacctgcggagtgagtgaccaggtagtagacggttctgagggcatcacacacttgagggagggaggaggacagagagggccatggcaccctttgactgctgagtgccagctgctctctttcccactgagaaatgctgcccccaacacacccagaggctctaggtcttgtcctgtgatttctgtccaccaagacttgataggaggtatgatagatgccattaactccagcactatatacacaggactgcagcaaaagcgctctcagcagaaagaggaaacagatacagttcatcccaagcctggcttgctgcccctttgaaagagagtttcaaacagaagcttcatggtgctgccttcataaaaacagggccaagctttccagaatctggcagagggctgagtgcccgcaggacacttgtgtatcactcacactggaaaacttaatcctctgtttttatttcagtggattgaatggcatgcagtttcctcagcagcttaaaaaaaatgcatgcagtcacttgcagacaggctgcatttgtctctgctggtgctcatgttacaagtttgtctgtgcatttgggcatgccagaatggcgtttcatttccaaacctttattgtggtcactttcctcttcgttacactgagaagtgttgctgagggtatagtaaggccctagttcatcaattatatcctgtacttttcttctaacttgatcccaagaacagtggaatttgcttcaaggtaaacaaattttgaataatttatggcccttcttttcaacaaaaatgaaaacgtgactttctaaagaaaagtcaattacaagggggcatttagtaaataacacactcttaataaagtaacaggaaaattaaaatgcccagcagacccattgcctcctgaacaggtgtttgctgctaatggatacagtttccatttccttgaagggatttgcccagaggattactttcacaacttctattgagataatactgctctaacagaaagagcaatgcatgaatctgtatatcagttccttaataaaagggaagatttttttagttcctaaaataccaatgaggtgaagaaaaacatgccacccaggtaaagttactctgtaatcacccgcattatctttttcaaggaatgtgggggaaatttatgtcagtcatcaggcaggtactagaagatgctaggggcctcacagacagcttgttcccggctgttaacatggagcagagcgttccctggggctgagcatgggagcccagcacttcttataggtaggtctttcctactataatattagatgcctacacttattgactttttcatttgctctttaaaatagatttcttctgctggttctgcttagttctaaggagtaaggtagaattttggtgccatacctaaatatcacgtctaaaatgacattggtagcacttttccaagaataaccagcatattgatcaagccattaataaagcctaattatttgctttaagaatgtttttggttgtttcaaactgagttttttccaaagtcataacaaaactaggagaggctgtagattcttaattattcattagattagggggaaaacgaattgctattacaaagaatatcatgcaaaaaataggttttaaaaaatgcattactactgagttttaaaaatgtatactaacattctccatatcaagaactgtttcatggatggtagattttagttatagcagtactggacttacactcagtcaaataattttaaattttctataattgggaatacatggtagctgaatataagcaaacatattactctatgaaataaatgcataagagtttgttatcacaaaaaacagcataacattatttttttgaaacacaaggctctgttttaacactttaccttgtttaatagtaacaaaacccctgaggaataggttgtattgccattttaaacactggagagcaaaggtccagagaggttaaatagctttctgcaggtcacacagctgatgaattgcagagtcagcatttaaccccggtctgcttttctgcaaagcctctgctcctcactctaccctaccgaccacctaagtatagatcagttaatcttgccttcagaattctcctttcttgtgtacttccatgtacattcatacttacttcacatgatgattctattttctggaagttccaccacatatggcgataatgaaacatctttgtcatttctctaagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtccaa

SEQ ID NO: 2639 - DNA, 118480 bp, Homo sapiens
tttggtgtatttttgagtagtccaaagtaatttttattctctaattagtcacctcacgactttatttgaatgaattaatgagaagctaaataaactagctttttaaaaaatattttcttctctttctccaggcaatgggtcactttggggcgctgcagaacatctgtgctttccctgtgccccatcaccttcccagctcctgagctgtagccatctctgctgcacctgctgtcagagggcagctcctccggctcctgctcctgggttgcaggtgccacatctgtgcagaaggcttaggagaagcagtgagccttctaactgcagcagtcctgacaaagcactttgtgaacccctccgggacataagggcatcaaactaggaacaaaaacacagtcttgactgtgatttggtgattttaccacatacaaggcccgaaagccaattgaagacaagaaaagaagacaaatctcttgccagcaggagtaagattgtacaggagtctgagtatacatcagggcaagccaagagacagggacaaacagagagaaaaggttcatgcaattatgaatatgacctggagggggctttggaattagattacaacagtaacagagagttaatgccattttgaaacaatttaagaattatgtatttgaaggaactcagtattatcatgttatccaaaattatcccagttgctcataagacttgctaataacctggactgggggtggagggttgagggatctaatggaaaacatctgttaaaattgaatatgataatcatgtcttgtttttatgatcttgctcatgagacagtcttgaagagagaactgagtgattatccaagtaaatgtgtatttctatgaagaatgtaggtgtgtcttgactttgcattccaaaataaaaatgactgatcttttccattagcacagtttgggtcagcctaactgccagctttcatgattgtatttatttattttccctaaggagatacgggcactttgtgggccttcccaggctgctgcaaaatgatggatggttgggctccgtctaatccaaatgacacggggtgtcaggagcattggtaatcgtgtcctgccgacttcaaagcccactgccaaaacatccacagcacagaggtttggcaacttcacataatcatagcaaaaggactgcaacgtgaaaaaaacaggccctgaaacagctatgaaaagggccagttcagaaacctattcagctaagatgtttcggctagcgccttcgcacggtcaccttgtattttcaccttttgagttgccttcacctggaccaaggttggcagcatttgtgattcaaagaaaagatgcccagggaaactgactctagattatggaaataaacattgtcttcaagggatagccagcaacatcaggctcagggctagtgaatcccaagccacagtgcccaggtaactctgatgtagcaggactaaagctgtctacctagtgagagctcctgaaagagaaaccccgcagcaaatctagacgttatcccttgtttctgtaaagtgagaaattgcagctatccatgacgctttatttgccagtaataatacagtttgccttacgagtggtagcttgttcactgttcaacaaatgtattttaatcatagcaggaattaagggtgatttgtgaccaggtgctgaactagaatttctcaatgacaaccccagcttcataggcctctttccattccaggcataaatatggaggctccaatgtgaaacccggggtccttctgttccaaaaggggctagaaataaaagacaggaggggaggcaagaaggacctggagaggctgacgccatttgggtgccaaacatcctatttccttggctctcccttgcacaagttcctggacaaagtaaattataacacaaaatccacaacattcagcacatgttttcattaagcaactttagtcactaaaaaaagtgcaaatgcagactcctgtataaatctgatttgccatgctaggccaagcttattttattacatacattctgcattctaagaactaataacttcatattgtaaacattaagcatacagagttaaaattcaaggccacattatatcgattgtctcttttgtcgtgtgtctttggctggccgagatcaactcgtagtgtataaatgcataagttatataattattatataaaaagggggaaaaacattgacttgtatacttcattctgacaaacgcacagcgttcgcgactcaaaggaaaactggaggccgcctacccaaaatgcctgcgtgatttctgattgtggcagccaagaaggccatctcttacctgaccctgtggagaacaaagcccccacataatgatgaggtcctgaatgtttctcttaaatatcagacaattccagttaaaattttcatttgacaaacaaagaaagagatgcgcatttttgtttctgaattctactacttcccctttctccattacgctgtgtcctttctcctaacactgggtttggtataacactgactgcatgaaccctcgagtctccataactcattgtacacagtccccaaatgtcctgagtccagtcttcattgcttgagaagtttctttcccagccctggtctcctccttctctgcctcttcctcctccttcttcacccctctgtctacaatcacacgctcactctatacacatcctcagtcccaccttttagttcatagtcccggtaatactgtaaaggagttggaaactttgggtcatcttcacagtttgagaaagctgacagctgtccatcaaacggaatgtatttgatttcaaccaaaacagcacatgccatgcagttgcatatcaacgtctgttgatgggccacagtctctctcgtgtcttttctcttgtttttgatatgtttctatttttaaatacaggtagttttccttaaaatggcattataaacggtatgttaggtcaaaactgtgttgtttctattgctttagtttcatcccagtttgcattagtgggattccaaactctactctaaagtttatacatttcttaagaccactttctttggcactttgtccttaagacttcatgcttctacatacactgtcttttacaaggtcagtccacagatgatatgtccatattcgtgacatttttagcatcctcctcatttctgtagtaagacttcagtaactccctcccaagagtctttggatctcttccccggcttccttccccagccccagtaaagcttttttcattcctcttgaggcacttttgattcatgttctccgatagagtttgtggcgatgggctggtgaatgcacgctgatgggaaaagcctccgccaggtctttagtagtaagtgcccagatgagaaggcatatggctggtggggagcctagtgttggggtatatacccccagttggtgaattccagtatgggtttggggcagcaaaaaaactggaagatgtcacggggagggctggagggtggggcgccacaaagttcatcttctgtgggtgggcgtgataggagcccatgtacgggaggtctgaggggtacttgtacagagatgactccggggggtggggctggagggcctgggcgatcccgtggaagtcgaacttgtaggcgtagcgcttcccatggaccttggtcatgatgttcttgtcatagtagtaacggagggcgcggctgagcttatcgtagttcatgttgggtttgctcttccgctctccccagcgccgggccacctcgtcgggatccgtcatcttgaactccccgttggtgccttcccaggtgatgcagctggagttggagctgtccgacaggagctccaggaggaactgccaaagctggatctggccactgcctaatgaggtcaggagaggaaggaaaactccagtgagcacaggttccaggggaaagaggctctctgtgatgacggaaggaggtgctattggtgtgccgcccacattcccttcaccaggcctgtccgtccatccctcagctgcaggggtgcggactgctctcgttccatggccacccacttctccagagaactgcccttgcctgaacagagccgccgcctcgcccacccccaggtatcccacagctgggtggactgaacggggtaccacgggccggcccccttgcctcaaggaaagaccaactccatgacgctattcaggcttcagggctcccgtgggattgggctgaaacagcgtccagctgcaaggaggcttggaggaggccagaaacttccttagcgctgcccctgcagcacttcccattctctctctcctgagaacatgccgttaatcagtcacctgcacaagcaggcttaccccaagctctgcatcaagggaacccgacctaggacgatgatctaacagattcaagacctagatggaatgcagcgaattcatatggggcaaagttcaggctgcttccatccatttctgacgtccttaaaagaacagccagatcaacctggtgtttaggggatgaaagagctatatatttttttttcctattttgtgaagcacaaagtactgttatgtggatggcaataatgacttaatgccatttatattggctaggtcaagtaagataataaaagttagatttaggaaatgaacttctaaaagtttatggaaaaaaatcgagaatggaagtaaacaccattatttctaacataacattttgctggcgctcagaaagcaattctgtgaaaacttttcctagaacagaattaacccactcaaaatgaggaagtttaggaaaaaaaaaaaaaaagctggctctttttcaaaccagatcacccagttccagtatttgggcaagcgcatcgtaacggaaaccagtgccttgcctgtgtgctgcaacgccaattgtgttaagcagcatttccagaagaaaaaccccaacaatgagtgattgcaagtccccttgggaagctgaatgagactcttcctttgtcaaagagatcacatttagctgggtggacaaagtcagaattttcttgatttcattgaaatcatacagatacagctttgttttatgaaattcaaagaaaaatctaggcacatcattctagctgctatgttacaatacttgaagatagtttatggctccctagaagacagcagcatgtaaatattgacagcagtatccgtaccaagagaagctaagctgtgctgaacatatttcagaagcttaagaacagatgggaggtgggtctttcctcccaaattccagttacagcactgccttagacttattaccaaaagattaccttttattatagtgtaagtaatatcaatcgatgtgataaaatgattaaagtaactttaactgacatctactcagggaagtaatatactgtaaaaatcaattttacgttcattttcttctaaatcctcgctagcctcctgtacatatcacccaacttataaactctgctttgcatgttggctacatggacatggatatttttgtgaatttatccatacaatagcactgtgagaaaggtcagctttttctgaatctatgctggaaagtgctcattttcagtctagcaacacatttgaaatgtattaacagcttgtagctcattgaagtggaagcctttgctttttcagaaccacatatacaaactgttcccaatcaagttttgttgcctccaacattttattaatatgcatttagaaaatacaaagaatggtatgagaaaaccatatggtcttagtatatatattgtaaccaaaaaattacaacttgaaaaaattccgtatatgacctgggaataggaaaaggcatggatttttgatttaacagtctaacagatgcttcaatataaacacatacggttgtttgaaaataaatattcagcgtcaactttctcccatagagaaagcaactccacagacctgccgaaatcacacttggaatctactcaaaccttggcattgcctcttagcaatttgtccctcacccatttctcttataaacgtgtgtaggacagaatcagtggacaaaagtgatctcatgtctctcctatttctgaagagttagaaagcaggggacctaaatttgtggcagcaaactctatgcccaaaggatggatgagctaatttctcacttgactattttacccagtagccataaagacatagggctcaggactgtgagaatttcaagggagggtctatagaaataagagaactgtaagcaaaattcatcagctttcaaaccttgaaagaaacctggaaatgcaaaatcaatgaatgtttaagtaaatggtagaaagagtaacatcatgtcaaactcattaattgttaaatttaatatttgtaacaaaattcgctgcattttgcagtgtgtagaacaaaatttctcactgcaagaattctcaaaaatgaacaatggttgttaaaaaattgtcagtggtaaaggaattattctcagtcataaaattttaagagcaatttttaaattcttattttacttccaaaacaataacatttaatgtgtgacgaggtgcattttagaatatagaatagagatttccaaacaagaatgcttagggtttaggaaagcctaaaagtggcttgggtcactcatgggccaaaccaggatttacaaagagaagttcttgaaagacaagagctttcattgagtagcatcaccacctctaccttaggactcacctttcttgggtaaacccttcagatctattttttttttttactctctcttaataacatccttgcgatgtcagtaaggaggaactaattttttcttagggtaattaccaaaataaaacatatttggaggtaaaaaacagtggcaagcagcattgtccacctacagagaaccctgtgggtgaaagggagcggctgtggcttttaagaagacagaggcactcctttaattttacagaggaaagtaatctcctaatattgttaaaagaaagggagagaaacagggtagcaaaggggtacagactgagcaaaaaagggggaaaaaaaaactaaacggtttacaaaccacagagcaaagcagagagctgcagagtgagtcagcagctgtgtctggtggaaacagcatcctggtgcaaagccctgcagccgtcagctgatgaacaagggcagtaaatacagccgtgaggggccccaccagtaccatgtggcagtggtttggggccactttctctagaagccaggggtggtgcagaagatcccgtgtgcatggcctggaccctctgcaaggcagcaggtgtgtccagcaggtgtgtcctgaatggaagtctctgccccgaggctcagtgaggctcaggcaccacttactggaggggcaggaaagcatggtggtagggagcaccaactttggagttgccactgcttcagctgaatcctgcctctgccctttgtgggacgtttggcaactctcgcagctctctctgcctcagtatcgtcatctgtaaagtgggggtgatggtaatagtactatcttgcaagatcatggtaaggatgaactcagtacttgaatggtcttgtcagaatttctttgggctgaaaatcagagtttaaggaaagataacactcctctcctatagccaggaaatgcctaaagaaagagaaatactgttcaattggcctattgaaccatgaagaagcttgaaacggtgctattcttgggctgactgatatcctctgaaagcttactgtgtgccatgcaccattctaaacgctttacatgtattggtttatttaatccccacaggaatcatgtgattagtccattggagaagtgacgaaattggagcttagagaggtagactgacttattttgcttagcgttggcaagggttgaaatccagactctaggctgccatgcttaatcactgcgcaaacttgctttcaggcctggtttatgcacacctctgtagcctcctcaggtcctttccatgttgtcccctccctgggggactcccactggaagactgcacactgccacctcctaacaaatgggaaaacatccctagcctggtctgtcgttctgcaagaggcaggatgtattttcatgtgcaccattgaagagtatccagttagcatcaaggaagcctctgaacataacccaccaaagctctttcattagaggaaccatgttagatagattctcagctgctctgatgggatgtaaaggagctgtgttgcttataaccgatccatgatatcagaatgcagggacacactgttctcagcaggaaaagtgatgtccaaagtacacatcaagtgaatatttgggatagagatgttgggatgctgacatcatcctgtgcattcatactatatgatgcaatctttccacttaaaatgatgaaaaggaatttgtattgtatgaagagcaaagacagcaatttttaagtgatgaaagatttatttatcagagaatagaaaaatagaatcaaacaggaagaagcattgtcattaatacaaagataaaagacattctggtttcaggggaaaagttcacatgagcacaacagacacaaacctaaagatagatggagagaaagtcaaattcatcagaaactaaatgaaataaatctttatcttaaagtcacttgcctgcaaatcaaagatgggatgttgccattttctccaggcccattaagaacagtcttaatggtatgaagcacagtcctccttccccaggcctgtgatgagtttccggtctccttgctctgagctcaggtccctctatctacaaagggcatccccgggctgctgggcccagggcatatgcagtgttcccttgtgaaagctggcactttgcttaggagcaagtgactcaggccctattctacaaacaagccaagcagtacctttgggctgtgacaacgtggtcatggacatatatgtttcatttggccaatgtgtgagtgcaaaggccagtttggtcttctttggtgcagcttgactctttcctcctcttccttcctgacctcagattcatcgcctgcacctaagcagttatgaccctgaaaggaaatccttgctttctattctcacagtccgcattttgtaagacctcctcttcccttcatacttagtcagtggcagagtagggcaagaaaacaaaagtagactttgcagacagagtcaggtttctaacctgacctcccttatcattggctgtgtgacacaggaaaagttacttaacttctctggacttctaattccttttctgtaggatggagatagtaacctcccagggctgttatgagacacagaagggaccacagacattctatggggggcattctgcgggatgggagctgtttgattgttatttcacatgattgtattaacattcccagagtgtttcagcttccgtcattttcttttttctaatctatcctgaacattgctgccagatcagtcttcctgaagcatgactgataataatcatctcaaaacatagtcattatttttatttgaatggttatatggcagagttgcaaatgaaaagctgagcagaaggctgagaagagaccacagcctcaggagcctgggctactagatgaaagccagcatgagcaaaaagggcctgtggctctgtgtttgggacaatgttgtaactacctgtgtccatctctccacggaccaaaagcaccctgagctaaaggactatatctcattatccttggcattcatgtatgcaacaaataattattgagcacctagtctaggccccaggctaactagttttctttagattttcagctgtgtaaaaaaaattcattgaattcattaacattaaccaaaatttaacttcaaaaatacagatgttcaataatgataacatttcgtgttttcaatgtgtagattctcttgcagggatgtacactgattaaatcttaattattccatttcgaaccttattttggcctcaacgtttaggaaatacacattccatcttgtgcttgcaatatgcctgtaacatcttggcatttgaatttgcagttgggaatatgcagcataggctatgaatttctgaagctggtgccagcacagctggttctgatctgaatacaaacaaataaaactatgtggttggcactgaaacactaggacaggtgacaaaccttggcaatgcactggttacaaatgggctaattaagaatctgcactttcttctagcatcgaagttcagaaacagaccatcgaagatgagcctgaatttgaagtcttgtggttgtatcaaggctctcttttaaaaaatactagttattttatctgcttgtataatgggttgaattgtgttccctcaattccctatgttgaaatcttaacccgcagtatctaagaatgtgaccttttttggagataagatcctaaatgaggtaatcaagttatagtaaggttatggggtaggtattccaacctgaccaatgtccttatgcaaaagaggcatttggacacagagactgacacacacagagagatgatgatgagaagagacacgaggagatgatggctatctgtaagccagggagagcccccaggacagatccctccctcacagccctgagaaggaacgaaacctgccaccatgacactctgatttcagacttccagcctccagaactgcgagacaataaactgttgttgtttaagccacctaatccgtggtactttgttacagcagccctagaaaactattacagcttggattaggttataatgttctttgctgaagctgaaatcttaatttataacccaacccatctttccattaaggcaaataattcagtgagacctaaaactaaaatctgttcagttgaaggaatttctcaccaataccaatttacttttcaaaataaccactgccaaaaagtaattttgtaagaagaaaatcatcagcagtttctcacctggatttgcaaggcggctacttgttggtccaagaatctgataaggatctacagcaaaaagaaacaaagtcaaatcctagacatagttgtaacatagtatgatgtgacttcagacataatgcctgacttaattgttttttcagatttcagagccgaaaatgtcctccaactccaaatcaactgcctccacctcctctatgagagaagatgtcacacggcatctcagatgtcttgctaggggactcctaattggtggcagggcttggattcaaccccaggatcctgacatatagctcaaggctcacaccaaccaatgatataaagagggcaaacatgtgccaagccccatcaatccagggccgtgcaggctgtgttgtttaggcatggaaagtaaaatctaaaaaattaatggatcacaaagaagcagcctgtgtgcacgtagaatttttttccctatttattgcatagttggggacgtgttttagcaccatctcaagtcacctcgcatgagtaggctgatgacttgggccctatcttatgtatggagctgtcgaaaagaggcaaacaatcatgttaatttccattaaaaagtgaagcattttagaaatgtgctgctgagcctgaatcttctcttatggttatccagacggcccctgaaacatacctaactgaggacgctggtcttcagttttgggcactgtggaaggagatggttgagcagctgaaaatccagaaatacaaaaggcaattagctataacagatttggtcactagtctttgatgttgttgcataatcattctatcagttaatttagttattaacataatagtctaactcagaagcatctcacggtaaggaaaaattttcctttctgatgaaatcaaatgtaaacactgtaacaaaaaaagaggacatttccaattatttaaaaaatggatacctcccactttttccaaaagtaaaaaaaaaaaagaatttggaatggcttaccaaacagattacaataaatcatagtctaagataaacacataaagggaaaccaccagtcaaataaagtaaagccagggatacttttaagcatggccaagattcaggaaaacaccgattatttaatgtgtactcaaacatcccatgaaacatgcatttgtgaaggttgacatacactacatcattcctttatttttgttatgaaagtcctgatgacccaaatggagaaagaatcactgcagtgaaagatcaattgtactcttgtcgtcaatggaacaaacccatcacatgttgcaaaatcacagattaaccacagaaattattatatactccatcaacagtcatccactgcctgtgacatgaaactcagggtcatgggagccaacactgtacctttcgactggggcgtggggtggccgtgaccggtccaggctgatctcctggggggctcatatggtaaatctgtaaagacaaataaattgactaaaagatcaatcatgtaatttttataagagatgctttggttttttatttgattttgtatttattagaataaactttgtgcaaaaaaatctggtaatccaaagaaatatcccactagatttgagttttatttacaaattaaaatttcatatattatagtggtctaaaattctcacccgtttgtctgaaaacttccattggcagattctcccagagctttccaactcttctaatttcctacaaccataagtcaagaccccaataaaagtttcttacaatctagttcatcctgcttccactgggactgatctacatctgtctctttattatcttcatgactcatccaaagcagagtctacaacttggatgaaccagcccatttttgtttgaggtctgttcctaaatcaatcaaatgacattcagcttctttttcttcttgcatctcctgggaagtgatcgctgccttatctttttatttgccagctgcctctcttagccaactcccattttccctttataatctcatcaatttatattaaatcagtcttatctgatctagtgattttcataggcaaatgtctcccatttctaatgttctaaataaatttagaatttctctaaaatgacctgcatgaaatgaattacaggactgaaatagtattgctcccacagcccattaatgatgaccttctgagcttaagcatatgccaaacatttctttgtatttataaagtcgtatcacttgtcctataaaccttcatttacttttcatatgcaaatttaataactatacttctgcatcctcagtgtgagttctattaatgattatcaaagctctatgtcatttcaagtttgtttcaaaaatatattacagaaaccttattataatactcttgctaagagtgcatagctaaggctatttctacatgcaatcttattacataactgtttcaaaattatgtcttcttggattgcttggtctcagttcaatgtcatgtgtcattctgggccaagtgaaggccatggccaaatatctcagcaggtactttgctgccagacaccaggagatgtgtacaaaatttcacttggagggtaggacaatgcaattgtttttaagcttctctttaaacaaatattttaattttgtttaaaaccagcaatttgatgggtcaatcttcaaagagcttgactgtgttgcagaagatgtgtctcttcctattttcatatcccaaagagaatagaaatgatgcgcaacgtgaaagtcaacacagaatctccttaatgtatttggtctgtttggctgcaagcatctttgctactagtgtggtctatgaaatcctacccttcagagctttggagaattagataatttttctttttaaactgatgttactcctctctctcagctggcatttttgcatttttggacgtaaatcttttcccacccagatcctcagattttcacatctcttgtgttggggttacacataggaattatatctgcagcccctaacaatttacaactgaacttcaacttaagtctctgggaacactctgcacatgggttctcagtcagttgcattttgtctaaaataaactggacagccagagtttcaatttgcaaattgtctcagaaagaaaaacctactcacaaggcaatcctagccacatctaacctaatttaggagcagaaaagcacattaactaaggccttctatttaccaaatgaaaaaaagcaagataatacagaaatacagaaatatgttctagatctctgtttctcaaagggtggtctgtggaccagcaacatcaacaatacctggtagcttgctagaaatgcagaatcttaccccagacctactgcatcaaaatcagcattttgtttattatctttttttttttttggaggtggagtctcgctctgtcccccaggctggagtgcagtggcgcgatctcggctcactgcaagctccacctcccaggttcacaccattctcctgcctcagcctcctgagtagctgggactacaggtgcctgccaccatgcctggctaatttttcgtatttttagtagagacagggtctcatgctgttagccaggatggtctcgctctcctgaccccgtgatccgcccgcctcagcctcctaaagtgctgggattacaggcgtgagccaccgcgcctggcctcagaatcagcattttaacaagatcctgggtgactctggtgcacactgaagtctgagaaagcctgctctagaccattgctcttttcaggaactctgttcctgcagatgatttcagaaatgctatctagagtgtgcaaagacaaactaaaaaatggttgaaagagttctagatggattgcttttacccatggcataagtatgctaatggaatgaatagacagcatcagtaggttagtcagatactaccttaaacataaaattgttgctcatgaaatgtgactgggaaaaaaaataaatgccgaactactattcccaaaatattttgaaactctttattcacaaaatccttcatatggtgtataaccatatcccatcctccctcgaaaataagtcgaaacttaacaccaaacagtctacttttcagccaagtatttgagacagttatatgaacaatgattcacatgttcataaacatattgccgcggaagataagtgggcttttgttttcttccatgacattctggtccaatgcttccttatcggctaccgatcacatgctgtgggcactaagtatccccctgtgggatatgacattgggaaacattcaactcaggctcactgagatgggggacagccaggggtgacttctttggcagctacaccatctcaaaaccttcgtagttctgctcttgactgcttgaaaaatcactcctctatgtatctttgctatgtgtcctttattgataatagagcatcagacttccaataagaatatattttacatttaattttcgctgatcatttcaacaccctctccatttctctttgactttgatcttcaaggcaatgaactcatatgcttggcagaagtgcccatgtaagggaaggctgctttctggcactggttctgttgttttatctgtaagagactgtgtttaaaaactgagctttatagaagtcattgcataggcagcttgggtgaacacagatgtacattacatcacaacagtataaaaaacagcatgaagctacaaatagggactcggctagtgctgaccactacacaccagcaactgtgtcgatttcctgggagctgggatcagcttctcattctgaatgagactcctcctccaccacacccttttgaagacatcactaaattaatacaacattctggctaccctttcctggagggctaagttcagccaagttttacattctcccttcatcaaactcactgaggaggaacgctctagctcttgccccacacaccccacaccgccaccccgctgcctacccgctttattttttaaagggcaagaatgtggatcgtggaagagctcatcctcattctgcaggatccacaccatatctgcaaagcaactctggaggttccctggctgggctggatgggaacagatgagatttgcctgctcttgaaattagatgctaatggggaacacaaattaggaagagcaagagctgctgctaagaaccaatctagaagtgtctgtgaaatgaaaaaaaaagtttgagtcaaccttaacataattaagttgctctctattttcctccagatcttcttaaaattctacatcaaagtttgagcatggagttttggaaacattttgcattcccttcttgcctaggtttgcatatccctgtggttatataagaactaagcggaagcaaagaatgcaattttagccatttgctaagatacaggctttacataacacctaactgagagatgctatgcagtagttgtattgtctcactatgcctagctgtgctgaaaagcactaggctgtgagctccaatggaggaataatttaagattccaagaaacccctgaagagcagcagcttcaaagtagaagcaaaggctgcatttgcaggcttaactctctaatctcttttgataacaccccagaggcatatcataatatatgggttgtcatggggatggaagaggaaaggatggggttgcagaacatcatccttgggatagaactgagcttttgcatgacctgctcctaagaggacaggcagggtggtgcactgtgtagttaataggggcttgcaagattctgtggatctgtttttgccactttttcccctgagacctcaaagggctatggctccaaaagaagtggattcagcaaaaaagaagggtgtttgtagaggaggtacagaaagggattctggtcgtagtaactgcaacaacgtgagaaacacgtgaaacatcataaaataaagtataataaaatatatatatatttaaaaaatcataaaaccacagaatgtaaaatgatatgcctatgggttgatactttatgagagtagagaagactgtctcaatgctaattcaacaaaggggttgtgaaagaaggtaaatcttgaatcaggaaaacgtgggaaaatactaggtacgggcatgcaaggaaaagggatgaggtttggacaaatggcaggtagtggtggtggcagggcatgttcacatgtggtcccctgtgaggtcagtgaacggcctcggccaattgtgcagggagactgaactgacacagcagcagcgagactgacctgacagggaagcagtcagggggctctggaataaatgatccacttgggaaggtgggccatgaacagaagaaaaggtagattgggggctgggcatggtggttcacgcctgtaatcccagcactttgggaggcagaggtgggcggatcacgaggtcaagagatcaagaccatcctgaccaatatggtgaaaccctatctctactaaaaatacaaaaattagctgggcatgatggcatgcgcctgtagccccagctactcgggaggctgaggcagaagaatcacttgaactcgggaggcagaggttgtggtgagccgagattgcaccactgcacttcagcctggcaacagagtgagactccatctcaaaaaaaaaaaaaaaaaaaaaagaagagaaaagaagataaaagaaaagaaaaggtaggttggggcagtaacccagggatgggtgactcacagtgggaagggaaggagggaagggtggtgaggaagtgctgggaaggtggatgcagcaggacaacacacatgtgtaggagtctctgcagaaagggtgcggaatgctgtctaatttaaccagtaaaccctgaacaccactgtctcctctatcagggactctataatgaaacggccaccatgcagagaagagacagattctggtctaagtagagttgttacctaggagcctggcttgcttcatggtcagcacaataacgctgaccagagttcggttccctcggatgtgggattagacaaagggtatggaaatgaagatcatggcacagcaaaccaagagtggaggagacagggatttgggtctgtatccccaaggaccttcaaagaaacagtcaacaatcacctttctgaaagtagtcaggtacccactgaccacagggatatcgtcagattcccagtgacctccctctggagctcgttcagctctgaaagttagtgatgcaaaagctcttccccctcagccatcacgacgttcattctccagttgcaggttcacagcttttatctccacaggagcagtcctttaaggttgatcgcttagcaatggatgacccgaggtgtataactagttcttatctccaagttcaagtccctgaatagggcctacagtaaatagtcctctggcttgttcagtctgctttaaattctttacaggtcagataccaatatttgtattggttctcataatcacagtagcagtggtcaaaacaggttatttcaggtacaaactgagtcgcgaaaacatacttgactagtagtggagctgtggaagtgtgctctctcccaggtcacgctcaaattatgggcccatggaagaccaccatcagagcggcatgggaggtgtctgagtttgccacccttgccttccctgggttgggcagagagggagtcccaaccaacatcctcacagtcaccctcttctccatccacctggatgggccataccttccaaatccaccatatcctaaaatgtgaaaacaaagcagctccaggacccactgtcttaaccaggtagcatcagtcagctggcttgtctgacagagagattgtgccaatgaatttggccagtgttgtgatcttttaacacagtttataatactagctcacaacccctggctttgcaactcagtcagaggcacctatgagatgtcttaacataaacaaacaaatacaaaattaaaaagtaaaaaaatttttaaaaccctagccaaatgttttggaaatagtttttatttttttagtttatatggaaatattttttaaatgctcacagaattacaaaatctctaaagcttgagtcaaacatgaatttctattttccactcgcaatacacgtggtggatgtctttaggaccaatcttgcagactctaggcactgggtcttgcccatgtttcaatggcctgtgaaatcttttacatgacagagatgacttactacctcttagtaccccttagctgctaagcctttccatcatgcttcccaggagcaagacagtaaactttttctctgacgttagagaagagaaaattgccagcctgaagtcactaggcagtaaccagggcagtgtcagtatttgaacagcctgagaagcttcctcattcattctctttagctccctgggcccccagtctttctcattagaaagaaagagtagttgccaagcctagatcttgaaccagttcgaactgagacttgtgtattccggatatgtgatagagtttaacatgaattctggaagcatgtatgaatatggagaaaccatcccaccaccctgaacacaatgtcatcagctgtgaggctggtacaatgatacctagcttatcgggctgatgtaagtcccagggagaggacaaatgctaaaggcaagctatacccttctgggaaatgccctctctccctgctcattattcgtctggcaaacatctaattcccctttgccatgtggccattcctctggaaagcatctttatgcctttcatgggggattgagttcctccccacccctgctcctacgccctgtattgctagaagtggttcctctaccataaaatctatcacattagggaaaacatttatgtgtacatatgtgtctctctggctctaggtcactctactgaaacatctagaactggaggcaaaacatttcggtttgttcaccatcataccatccgtggctggcacagaggaggcactcagcaaatgaacaaaccaagctgaatgaagaagtaaactttctgaagacaggaagcttactgaagcctggttcatctatatattcccagagtctaacaccacgcttggcactaatgggcacttgatagatgtttatttttgcatgaatggcatgtaaatttattacctaattaaatcatttggaggacaggcagtaagattcagatgtaaatactactggttgcatgcttctgctctgcaagactggcttcttgtgacatactgataatcggtcactgtgaatctggggagtgtccttgttttgtgctcttcccccgaggagggacagatccttctgttagttcaaaagtcggcctattcctaactgccaggcatccaggatgccttctttgcccatctgtctttctgaaaagctagttaaagggctaatctgctcttaattcctttagtgtggtctttgaatgaaatggtttgagtggatttagtctccaaatcaacagaggcagaataagactgtctgggactggcttcagctccgggatcagctctctttgtatcacgtgacttagggcacggatctcagcaggacatctgggatgtctctcaatgaagagatcacacaggggtgttttcgtacctggcctagttgtaattctttgcgtagcttcaggatatactgaagtatttgggaaaataaaagctgcaccccctgcagacaaaaggaaagacaaacatgtgaaggtcttttgttgtggttgtcgatctcaacatcagcgccaaatctacttttccctatgacaacaaagggaagagacctcctcaaacctgccttaacagagctccggagaaacagacaggtgcacctgtcagattctcaagatggaagtgaaacttggagccttggtgtactcctgtgccccgtttgctataaagcgttttgtgttttgattttataacttcttgatgaagccctatctgtgtccccctcaatcccacttcccactgggcaatctcgttttattaaaaaattatatggtacatgttttatttttcaacttgtataaaaacccataatatattttacagagcttttggaaagtagtatcaagcaattataagtatttagcctaagagtatatggattttattaataattaatccacatctctattcaaatgcattttccctctctctcttttgaccaaaactcatgctgttagctgagaaaattcccttttcatagttcagtccatttggaatttgttgtcttgttcattggtttcttccgtgtttaacaatagcaaaatttaatatatttggagcttttttgaaactttcactcaatggttaaagaactcataaataaatgtgaaattatcagaaaatgtgcatagctcaaaggtgtttcctaagaaggggaagtaacttcctctaagttatctgttatttctggccacaaggtcactaataggctgatgtgtgcaaccaaaattattgaaaaagtgtactaccaactcgaagcaggttttttaaaacttcagattaaaaagacaatgtgttgaatatagaagaccatgataaatgagcaatttcattgtaatactcaaaccgggactcactcacattttatattttaaaataaaatggtaaatattgggaaaattgcgtatttctatgtgagggctgatcgtgagttaactggctgacttgcaaggctttctggcacttcccgtctccctccctagcccgagtgattgtggagggtccctgcagctaacagagtggggtgagcagccggtggccatgcttccggaactctctccatcaggaaggagcagatggatgtgaaccaggaacacattcatccacagaaaacccagcctctgctgtgagcggggggcgagggaggaaggttagccaggatgaggcacggtgttaaaccctacttaggctcaggcaaaataaatacataactaagtcaaatgtagaggcaacggttagagatagaaaacaggcatttggttagtgactaatttcatattctccaaaattatagcagaggttccctctgaacaaaagctctcaaaatgttacagaaattccctcctgccttttgcaaacatacaaagtctgtaggaaaacaaatcaaatagcctaaaagtttattggaaaggaaaaagaaaattccaacttatcctagcaaatatttctttaagaataaaaatggaaaaaattaaaggaggttgctaagggcccttttatatcgaacatgcttttagtgtctacagagtcagcacagcgaatatattgggaccaacagaagaagactgtaatccggcaaatgtgagctaagttatggctaaaggcaaattctgcacgtctcctggttaaaaaggaaccctttgataatcaaagtggggtgcttgggaagcgctcagaaaaccaaagggcttcaccttcctttaggctgtggtacattcctaagtatccgaaagtattctgaatcatctacctgcgttctgtcttcctggcacgcgctgactggtttcccatgaaagcatgcaacctgtacgtaagaccctacgctcttgctgggaggcaggggcggggccagcattacctgtgtttctagcatgcattaaccgtggagagttttgtaaggctttatcaacatcatctgaagtcaaatgtggaagaggagctacaaaacaaaacaaaaagcgacatcaaaatgaaaaaaaaaagagagagagagaaagagaattacctttcttacaaaaaaaaaaaaaaaaaaagaaagaaaaagaaagaaagaaaaccgttcccccactcccacactaacatcatgggaagcttataactatttccagcaacctgctacttgttagcatgttaaaacctacatgggggcccgtctttaattcagggaagaagtggttgggatgccaggcaaagcaatggaggagaatttatccacctcactgtctgtcacactacttccttctcaccatgctggacgttgtagaaattaaagcatgcagcaaacattctggattcatgccaacatgccatccctttctgtcaggttaagccgaatcacatgatacaaagtgaaaacttcccttgttctgtgctcaggttagaatataaagtggggcttcatgtagctttagggagaataatccccctaattcctacgaaagagaagccttaatgattctatttcgattcggggtatcatggagacttaactaatgtgtgaccagttaacgcttcctttcccctttgacattccatcttcttggtcgcaggaccctggaggaggcagctgagtgttgaagtgaattttggcttctcctgagagcgctgactacttctcatcaggtgatgtggccagggtgttgctcccctaagtcatcacataccaagcatgtggctccctcggatccccagtgggaactgggcgagggcaggaggatgctgtcgacacacctggttgaaccctctgaagctcaggtcataagaaccatagccacagccatctatccttggaggaagggggagcttactctctctgaggtagtggagatgtgagagaaggatgtcggcgttgtagctgggggtgagcctctggaagtcgtccttggtcatcttgcacagttccttcccatcgatgttctggaataacaagatgttgacgtctggaaggccatattctttcaccgcccactccagccactgccgcacatggtctgtactccatagcgtaggatctgaaaggggtgggaacacattcagtcaattcctgaagccagggatcttcatcttggggtagatccccatccacgtgggatttctgaccagctgccttccacaagcacagcctccagccagcctccctggctacccaggagaacattttgggggaaagacaaaagctgcctcacatccatagatcattgtctttaaagtgaatagttctggaatcttgggattattcacatcacatgcccttgtttttgctcaatctaaagtttcctgtaggcataagattttaaaaattcttttttctcatttatgttcaattttatttatttattttaaaatgagtaagaataagaggaaacttcttttccttagaaaactactggtatatttatatatatttatatggaaataagagtaagccacacatatcaggaaggtgctaattacagatcacaacaacaacaaaaataataataacagtatttatgcaaaatactgaaaaatactgaccacagaatcggaaatgaaatatagatacaccaagactctagcccctcctatgagccagcgttcctcatagagagctgtcagttccagacttttcctgcagggtgtttggttttgcaattaaccagcacctgcaggagtggggttggtgagtggtttttgcattccacagctggccatggcgagcacaaacaccccacaggatgcaggccacgtcgtcacactccagtgctacctatgggacagggagagcagggcccgggggagaaggagcaggtgatctccaacagaaacgccagccgggatgtcctgtggtaaacaccctcagtggtagggtcttcagagtgtggtaaatggggcggctgctcccttgggccccgagccctgagagacacatgggcagggagttggagccctgagttctaatctcaccatttctccactttctggaccttgctgtgggcagctatttctcctttctgtgtctgtcccacctgtaaactaagagcactgatctcagttcccgggacaagcccttaggggtcaggcatgccaggatgttccagtcctcttgaatgaaagtcaggtgtgggagtcacattttagctaatactttcagatccttgtttgtttggtcccactaatattttaggctactcaagaatggagcatgtagtatgctgctgcaatacatttttaggtttgcagaggtaaaccgtaataatagtgagaaacagccagccagtcatacacccagagttctcttcctctccctccttccctcttccttccttcgcttctccctccctttcttcccttcagctacatagaagaaagaaattattgcaggtccagtagaatctacctttcccattccattctcctactgcaaacacctatcctgaagttagtagctagtggttagaagtaaccactatcctgaagttagtacgtgtatcactcctatacatattttaatatttttaccatttaaactacatatattgttttgtgtttttaaagttaacataaacgatatatgatttgctattggcactcaatgttataatttcaagatgtagccaaatgaattcacaaagatatactcaatcattaagcagctcttaggcctcccccatgtgaataatctcaatttatttagtgaatgtcccctgtccatctccatgcatacgcgtgaatgagtccgcattggtccagggcctggggtcctttctggaatcatctggggagactgaaaaactagtgatgcctggtctcccctgggagagtctgcttcaattaggctggagggcagttgggcatcacagttgataacagctcccccaggtgactctaatgagcagccaaggttcagatcatcttccctgggcctcactattccaagcgtggtcctccaaccgcggaagcatcagcatcacctgggagctaattagaaatgctgagtctcaggccccacccagacctgctgaaccagaatctacattttcacatgaaacctggggacacgctggccttggctgagtacctagatacgggatttctgagttacagggcacatccatcttcaacttgaccagctagcattggatgtctaccaatatttaaacacccacattctcacttaaaaatcagtgcacaggccaggcgcggtggctcacgcctgtaatcccagcactttgggaggccgaggcgggtggatcacgaggtcaggagatcgagaccatcctggctaacacagtgaaaccttgtctctactaaaaatacaaaaaaaaattagtcgggcatggtggcgggtgcctgtagtctcagctacttgggaggctgaggcaggaaaatggcatgaacccgggaggtggagcttgcagtgagccaagatcaggccactgcactccagcctgagcgacagagcgagactccatctcaaaaaaaaaaaaaaaaaaaaatcatcagtgcgcagaacctgaaaactaaagggaactctggttttgctacagagagaatatcaacaaaaactccaacggcagtgatgacagaaaagtgtacatatttatttgtcatccaaacacttggaaacatgttgttagtctgtgaaaactgaatgtagatatggaaggttaatgttatccagttcactgaagttcagatgactcttcgtcattggctgagaatttggctttcagagataaaatgtttcttttttcatgacatgtcagaattcctctttctacaaaaatggatcatactgaggtcttagggcaagttctctttacctttggttctgtgcagaggatagtttgttcagccctcacagagagaagaccccccatcctacccaagtcattccctgtaagttccatcctttgatgttagcgaaacccacctttttgttttgttttgctttgcttttaacaaaatgggaggactattttttttttaatgtaacaactgtacttcctagaaataagttcattctgggaacagactttcttctctaaatggtggaaccggatattctcaaaatgacacataaacatattgtctgaaagccactaggttcgtgttaaaatggtgaaaggagaagtttaatctctctattatcccttggtgtgccccttaattggtttcgctcatcaagacaagggttatcctggcccattcagttttcctttaagggaatcaggtgcaagaccccagagacaaagtcctcaacctgtattgtacttatctctacaagtctcactttgagttggtaaaaggctgttctggagttccggagttctgccaatatgagtataaattactacagcctttctgatgaacaacacaataatacaacaatacaacacaacaatacaatcaaacgtctttaaatatgtgcagattccctggcttaaaaattccatttctagaaatttatcctaaggaaataatagaggatgtgcgcaatgatttattgtcaaggatgttctttgtagtgttgtttataatagcaaaacattggaaacaccctaaatgtccagcaaaagagaagcagttttgtaatgcatttaggaatgttcctgtgatatttagagactaaaaattacactgttgaaatatatttattgatatgataaaatgttcaaagtagattgcattttaaagtttcaaaatattattatgatatcattgtattttgcaaagatatataaatatctgcacagaaagaaattcagagggagatacagcaaaacgtgaactgttgtcactgagggaaaggagatggggaattttagatttgtcattttcactaaactatattttctcatttttctataataaatatggaatacttgggttacaaattatttatacaaaatgtattctctatttttcaaagccaaaacatggtcttacaaaaggtatatatatatttaatgtatattatatgtatactatatatcacctatatataatatatgtgaaagtatttttataaaatactttaaatactttataaaaagtattttttaaaagtataaaaaataaaagtaaaaaaacaaaaagaaaagttaaaaaaatgaaactatgcaaagcattttataaaaagtataaaaaataaaactactaaaatactttataaaaatatttttataaaataataaaatatataatatatatagaatatatacttacatatatgctatatatactacctatatatagtatatatgtgaaagtatttttataaaattgctgtcaagagtataaaaagttaagtttcagtttcttttatattttgttaatatagactgcttcatctgaaaagagtaaaattacatgaagtcagaacactcccacatccttttagcatttgatctccacacctctgccctataaatttctaagcaaacaatggtgaaaacaaaacatggccactcggtagaagaaatgagggcattccttttctcctgagcactcgcaccactctcccagacccactccggaggtgttgcaatagaggacagtttgcaggggaaaaacccagattccccagcatgaagcacacagtcctttgttccatgggtgtcattcccaaccattccccctccaccctacatttcctgagccaatgcctccatgcctgtgccacatgccacccacagcgtgaaggactagcaccttcttgtgccctcacctacactcacgacctcctttgggcatctgtcctagatgttctcacagaggaaacacttaacaaatctctgggcagtgaagtgataacaagactgaagacctagtctctgctcacactgaactccacctccactactttggccaggcaatgatgctgcagctgtagatgatggtttttagagttcaggtcagtgcactgggtccaggctgtcaggttttggtcctaaccttttaactccatgaagagccccagtagtctctctagtctcctccacactccatggtatctcagcaaagctttatggcttctgtcacaccaggaatcaaagaaaggggctcatgagttcctatgagattcagcaggcctgtcttcctcctttcttgaccccaaccacacatgtgtaggaggaaggggaggggactacagcataagccccagccgaggcatcacctttgcctatgtttaggtgcgaccttctgccctaggtaggaacacctcttgtctccaggtagcagtgtgtttggaacctgtcatttaattttataactggacctcatttttctcttctgtaaaacaatgtggagaatttcaggacctgagaaatgactcgaataggataagaactaagatagatttaattcaagtaaaagtcattaagcattatgcatatggctatatgcaccagtactatggagattccaaagtgtccaagaccaagagaaacactaaggacccactgagagaggcagcttatgaccacaaccacaaagcagaactaagtctctgtgatcaggctgggcgtggtggctcatacctgtaatcccagcactttgggaggccaaggcgggtggatcacctgaggtgaagggtttgagaccagcctgaccaacatggagaaacctcatctctactaaaaatacaaaattagccgggtgtggtggcgcatgcctgtaatgccagctactcaggaggctgaggcaggagaattgcttgaatccaggaggcagaggttgcgataagccgagattgcgccattgcactccagaagcctgggcaacaagagcgaaactccgtctcataaaaaaaaaaaaaaaaaaaaaaagactccgtgatccaaggaggaagtggaagtgcagagaggtagcaccaaccaggaaaaatgggaaaggcttaccaggagagtgaacttggattaacagcgaggattttgacagaagtagagagaagctctttggtttaggggaaccacttagcccagcctcatccgacatgggcatgaaatatctgacatgtttaagaaaaagggagaaatttggtgtggctgcagtggaggatttcagagagagcacagcaacatacgaggatggggatgaaagctgggctcagatcaacaaggtccttgagtcttgctaacaaggttggattttcatttttagagatttcagagtaattgaaaatttctaagaaatttttaaaaatcttaaataacaccaatcacagaaaacttggtgatgaaaataaaaggctttattgggaatccaaatacccacattgggattcttattcaaccatttactggacgtaaacgtcaacctctctggaatttgttttatatttttctgtgggtaattaaatgaaatgttaggggaatagaaaagtaaatgagataatggatgtgaaagcactttgccaacaataacatactgcaaaaaaagaatgcatccacacactcgattttgcattgcaaactctgctaaaatggaataagaacaaaatctgttatcacaggggcagcctcctccttaagacacaaaagtccaatttataattttattttaagaaacttttggagatgcttctgtcagatgaatcataagccattgaagataagttgttcattttcagccttccattccaattgttttgaaaacatctgtgtcatcattctacatgtcatggacaccaaaatggtaaactgtcatggcacaggctaaacagaagccatcactctctgaagcctcttatttgtatcttaagttacatggttattatgaaatctactttggtaaattggaatttaaaaaacaaataaaagtaaaccattacacacagagttctggagttgtactgttaatgtactctgtatgtggagtgggagtgggggtataagcagtgggagggagggaggaaggctgacatttaaaaaaaatatttccatgaaacaggattctgacctagtagagttcccctgttgccaggaaaatattgagtagatatttaaatcaggcaaaggggcactgcatcgccaaagacaaactgtgcctttgtgaaacaaaatgcctcacacaggcaaacatcttctttcagaggcccctctagagaaatgaataaagtaagattaaataaaagccaaactggtgataatgaaagtcctgaatgttatttttcttaaataatatcaacgtaaaatattggcttcccaaaagaaaaaaattactcttggttatgaaaaaaacatcaaaaaataaaaactaaaatgtacctctaagccatatcacaagcctagtgaggtgtttgtttataaatccaggccctgggcaagtcagccaatctgctgtccaagacactcataagcctgcaaaaataagatttaacatcttgcatcctcaggaggacagaagttacatttataaagcaggcccaatagagagaactggcttaaatttgagcaatgattcactccatcacaaatggaaatttgatctcaaataaagagcctacctcaagactgtttctgagccttttaaatttctaacttatatgtagagttcatttattgttttggtattgatttctaattttattgcacgttggccagtgaatagagtctgtatgaaattaacattttattttattttatttttttgagatagtgtctcgctctgtcacctaggctggagagcagtggcatgatctgggctcactgcaacctctgcctcccaggttcaactgcctcagcctcccgaataggtgggattacaggcacccaccaccatcgtggctaatttttgtatttttaatagagatggggtttcaccatgttgtccaggctgatctggaactcctgaccttaggtgatccacccacctcggcctcccaaagtgctgggattgcaggcgtgagccaccatgcccagctgaaattagctttttaaaaagttccggtttgttactcttttggcggcctagtgcatggtcagtttttataaatgttccttgattgcttaagaaatgcatattctctaatttgggagtacagagttctagaaaaaaaactcttggtaaggtgtatttaattttaatgtcactgacctatcaattactgagaaatgcaaattaaaatatctcactaaattggacttgactatttctttttgcagttcattacatatttcaaggctatgttattaggtacatgtaagtttatcattattatatatttgtcatgaatttagccttttttcactatgtaatgaccctcaattatctccagttatgctttctgcctgaaagtatatttagtctgctttctatttctatttttgtcagctttttaaaaattcaattttcactagcgtatcttattctgtcaactctcaatctttgtttgtgcaagatttttttgtaaacaacccataactgattgtggagtattttttagtctagtctatcactctctgtctttaatggcaaatttggtctatctacacttattatcactgatctatctgatttttaccatcttattttgtgctttatgttaaactttcttagtccattctctatttctccttgccaagtgtctaatcagattgatctacttttcttcattcacttttttttctttgtttctgtattggttttgctctttgacattctagttctctttcctgttaatctttaaacaaaatctaagtttaattaccagtaatttagaaagcttatacttgaatcatccatctctgattttacatgacaatgttccctcatatttttactccactgaattttctactccctacttagggaggctgtggttgtcattttacagccatttctttctagatctaccctcaccttaatcaatttcattgctcccatttccttcctgtatctcactcccttcttctaggatccattttttaaattaaatcttttgttattatctgaagtgaggttcaattagcaacaaactctctttttaactccttcttttatgttcttccttaatatttaaaaagtttatttattttatactctttatccaatactttaattatttaaccttctgcttaatcatgttcattgtttctgttaaatcttggttgggggagatctctcttcagctatttttttgtaatttgcgggtggcagagtcatctttagcgggtctctatctgcaggaattctgtacagcgtaggttgaagacatgtctctccatgaagatttcgtatttacttctgccaggtttcccagattatcactagcccatgaccatttttctgtattaatttctcagccttagagttcctggcacacactgttgtgtgtatggggtggggactcgggtaatgacaggctcagttccaattctctgctttgtggaagctcaagatttcattccttgcccctagttgacctttaaaacccaaatctctgcattatagcaacctaggacaaccaggtgtcaacataagaatgtgctgctctgctctattctcacttttttccttattttagtccctaaggagttcattgcctttcttcccagttcagctgtgcatttaaaaggatgttaaactccatgcagcaattccaggtgttttgcaaaaggaatgtttctcaggtccttttatagtaacctctctattttactagaaccaagagccctctctgcatactttttacctatttactttgaatagttttcatttttaatgcagccatcatcctaactcatgttatgctttacttcattcatttattaattaatcaattgtcaaaaattacttatatgaattgtataatcctctatgaaagattcaaaaatggcaagaaagagtgcctgtcctctacttgtttgagaatctacaattctgtgtattttatttaaaaatacatgactaaattatttttgttaggctctaaacatagctttgtcattctgacacactgatttatttctctggatgaaaccattctcaagtaatcatcttgtttttggataatgatcgttattgttctttgttttcttttgttgttgttgcctcctgttattccatgacaacattgtgtgtgctcatcatgttttagaaatgcaatggcttgttccacataaaggtttctccctgcctgggttttctttctttgtcttctctttaaatgttgctatccccagagtttcatccttggtctacccctctcctctctccatatgtatctttgggcattcttatttgctctcatgtttgaactataacatgcatgctgtattattttcctagggctgccgtaaccaagtaccacaaaatgtgtggcttagaaacaacagaaattcatcgtctcatagttctggaggatcaaagtctgaaatcaaggtatcagcaaggccttgctccatccgagactgtggataaaatctgtccttggctcttctagcttctggtgctgtccagcaattgaatgttccattgcttgcagttgcatcagtccaacctctgcctgtcttcacatggagttctccctctgtgtttccatatcatcttccctctgtgtgtgtctatgtccaaatttctcctttgtgtaaggacaccagtcattttattaggctcaccctaatgacctcatcttaacttgattaaatctgcaaaacctctatttccacataaggtcacattctaaggaactgggggttaggacttcagcatatcttgtgagggaggcacaattttttaacctgtaacaggcagctgtttctgccagtctatatcttgagtccccagggcactctcacagatgccagacccaaatataaacagaagaactgcactttttatcccaggtactgtttaagcatgtcacacatattgctatatttaatccatatagcaccacatgaagtaggaattattatcatccatattttggtgatgaaaaacctgagaaacagcaagattaagtagcttcccagatcccacagttagtacatggcagagtttagaactcaagtgctgtgactcccgatcaaggactttccatcctgagctctaggcccaccacactgcctgacaggtgtcccagaagcatcttaaacacaggatgaaccaaactgaaatcacctattttaaacattttttttttgtatattcattaacacctacccagctgctcatgctaaatctaagctgtcttcaattccattcttctctttgactttcaagaaaaacagataacatcattagcactgtagaaatgtaaaaattagccctgggcaacacagtagattattttacaaaattccctctccacctcctttgtttacttaagtcttatttgaaaaggctgttgcagaatgtctacaacaatttaacaaacacattctctcatcccattcctgtgttctcccctgggtatttttgtcagcacagcttaggaagaagaacccagactgtggagtcagaaagaactgggttcgaatcctggctcttcaaatgattggctgtgacatatttggcaactctcttagcgttcctagttttagtttctttactgtcgagtgagaatgataatgagtacctacatcatagggtggtcgcatgatttaaatgagataatgccttttctacaaagtgcatgtccaagtgcctgacaacagtgcatatcaatagatagtagctgtcgttgctttttagaaaaatgacttgattttagcctcacatttaacccaatggtggtttcctcaaccgctattcagctgataactttaaaatacacataataaactttgatgttagcatttctattttagtgggttttgttatttagttgtttgagcatagcaggaatttaaacagaagattaaagaagcatgtcccatcatatcgacagagtggaagagatcctcgggtgtgttcagggacgtaacaaagaaagatgaagacacaagtcatttcaccagcaggttctgggcctgagaataggctctggtctcacccagttgtgcaagtgttcccgggaaagtcatttcacctctctcagtcttggttttctcatgtttaaaggaagactgaacttagaccaccaagaatcctgcaacccctgcgagtctgcgattcctgctagttagatctagattactgttaacttgataaatcacatttactctcctccacacagaatccaagtgctggctgtgttgtctggcgattgagaacacaaaagacatgatcatcacctcactaaacttacaatctaatagaacagacaggcttataaataactcacgctaagaggattggaaacataatatatcagccatcagggcttggtcggagggtatgttctattacttgttattcactggctttcaaagcccagtgggggaatgtcaatatttagggaggatcatgtggaaactatgcagtcctctaacactctgagaactcaagatcccttctttacatgaaatcagactgccaaagactcatgctgggtgtctgtcctctacctgtgctgagctattctctaatgtaactcagcgctcacagaagatgtcacaagaaataagctgttgaaatgcagtgctgcaactgtggcaggaagacggtcgatggtcaggtctatggccccagtggccccaaaagggatccttcttttaggattctacactatgataaacattgccttccctgtgaaacttcttttttgaaaggaaaaattatttccccaaataactcttttcattttggctgccaggaagctcaaagccatactagaaacttaagtacagcatcttgggcaagcttgtggtcaaaatggctgcattcttccctcacatgctcttggcttctcatttgtatttttaactgccttagcactgattcctaatttccatttgataagtcaattgggtataagcccatcagtagtttagttcacacggcacctcaaatcctttgcagaatatccacatttaagtaagtatatacatgcatttgagaatacaatatgaaacaaaataaagtatgataacaaaataattggtaagatgtcataagaggagtgattaatttgccagaggatcaagcatggctcccttgacagggcagattttgaagatgtctggaagaatgagcaagagcattccagagagggaaccgcagggacaaggacaccgggtggtgaaaatgcagcgcgtgagttggggatgtggcagaggaaaacggcagaggctgcaaagggctttcgaaatcacatcatcgtgggtataaatgaagctgttcttgattcgtcctgtcatagcaatctccattcctcacatgctctgaaatactggtctgagtcattcatttgagctctcaatcacaccttctcctgtctgtcaaaaactacttaccccacatgggtgggtcttagctacttctgacagccttcggtcatctcctcagtgattaagagtaatgggaactccatgaacactttctaacggaatagaaaggtcctagcacaggggtctgagtaagacacaagtcatgtagcttcagccacacatgtttggtgggcaagaaaaggtgattttaaatctcattagagcttttattcacggtgaatggaacacagtaagagtttaatgaatgaattaataatgaagaaagtgaagagatacagtgaagagaagaatgtggctactcttatctctgagattactgattattgcaagggtctatgctgaaagtgaattattttaaaaatagaagcagaggcatttgaaaaactcaacactttagcacctattttaaggaattaaaacagaaaaagaggccaggcccggtggctcacgcctgtaatcccagcactttgggtgaccgaggtgggtggatcatctgaggtcaggagtttgagaccagccttgccaacatggtgaaaccccgtctctactacaaatacaaaaattagctggctgtggtggcaggcgcctgagatcccagctactcaggaggctgaggcaggagaattgcttgaacccaggagacagaggttgcagtaagccgtgaccgcgccattgcactccagcctgggcaacagagcgaggctccatctcaaaataaataaataaataaaaaataataataaaaaaacagaaaaagagaaatctttcaaaatgctataagctgctaaagcgagaggtcctattgcattttggtcagcattttgcaacttttaagaagtgaatggagcctgtgccttcctctttgttagccacttggttagcacatctccatgttcacagccaacacctaaagagtaacagtaactactgcaatgagtgattcttcatttttttttggaatgttaatgtgatactgttaatcatttctatctttcctttttgtctacttgccttttctaaaagtgataaaccatatctttattaaaaataattcaagtctattaaagtaaaatttatatcttctatctagattagaacttttcaaccttattgtacatgaaaattacatacacaataagcatgttaataatgtaaaatttccaaccccacacccaggtttggaacatttggaagtgtgtgtgtgtgtgtgtgtgtgtgtgtgtgtctgggaaagggtctcactctggcttcctggtgggagtgaagtggtgcaatcatggttcactgcagcctcaaacttctgggctcaaagaatcctcccgcctcagtctcccaagtagctgggactacaggaaccaccactacacctggctaatgttaaaattttttgtagaaatggggtcccactatgttgtccaggctggtcttgaactccttggcctcccaaagtgctgggattacaggtgtaagccactgtgactggcaggaaatgtgtatttttaatcataaattttccaggtaatcttgatacaagtggttctgaccatactttgaaaaacactttctaggccaggcgtggtggttcatgcctgtaatcccagcactttgggaggccgaggtgggcggatcacctgaggtcaggagtttgagaccagcctggcaaacatggcgaaaccccatctctactaaaaatacaaaaattagcctggcgtggtggcgggcgcctgtaatcccagctactcaggaggctgaggcaggagaatcacttgaacctgggaggcagaggttgcagtgagctgagatcctgccattgcaattcagtctggggaacaagagcgagactttgtctcaaaaaaaaaaaaaaaaaaaaaaagaaagaaagaaaaagaaaaacactttctagtcaacctccaaattaagctcggccaaaaaagagccatgtaaccagcatgggggatgtcacacttgtcaggcccctcttattacaactggtttcactgaatgacacttgggtttacgacagtgtaagagactgccctgccctatgagagatcctcctagatttacagatactcgcaccaaatacatagataaaaaccagagatgggaattatggcctaaccagtaccctttgggaaggcacaatcaacagtcttgccagaacaacaggcacaaaccagggctgcccagaatgcctggtggcgctactggttgaatgctttgctcatgactccccttatcttccttaggacaaacagaggaacacatcttcctccagactcagaattaatagctggaccatcttttcacatttgctttctttttatcctgtaggcactgaattatccctttcatactgcctgatgatacctcgaagccaaataacacctaccttttgcaattctgcaatatttaaatgttgcaattaaaaatacacatacacacacacacacgtgcgtgtaaacctcactcctggttttactctctctgttcaatttttactttagtccattctccacattcctttatttttaaaaagtggattctaccgtgctctttcatatgtatctatgtgagctttcttaaatctgttctgaaataggaggcagtgtaaatatatcaagtgacagtctacatttatccttcagggacattttctagttgacactttcttatgggcttttttttgacactttttttatgggcttctttattaactcaagatcatgagtatcaaaaccagggttgagggaatcgcttctcaaaagtgggttccaggtaccagaacccaatctgaacacggacaaagccccccagctcctctgtggttttatctctcagtctccgtacagtacaaatttcctcatcagtgtttattagggccactgctatctctagtgtgtaaacatcggcatgtattgatgatggtacaaatgtttaggaataactgatggtttttttttttttcactcagctatccgtgtgatttgcattagtgccaagcaatgtctctaagtagtaaggtctatgtgaaccactcaggaccaggtctggagaattctttttgcacacatggggtactccgtgccccaaatctgccttagtgaggtgcctggataccatggggatggatacagcagctggtacagctgcctgaggtcctgcaacctcatggccacattggaaaattgtccagattgtgcaatgaagctgtgtgtgtgtgtgcgtgtgtgtgtgtgtgtgttcatctctgtgtgtgtatgagcacacatacatgaagcttgaccaataactgaaagactcacaacttgcaaaatcagccacaactagctctcttacaaacactattaactgaataactgcctacactggcgtgaagcaactgaaggagggaagagctgaagagaagagtactttgctccaaagaaaggaaacagccttcacatcaaagcttactataagccaatttgcagagctatccttgcatccatccagctaatatttgatgagcagctactatgtataaaaaatcctgggtgctctgacttcagttgattctctgttctcttccccacacaaatatctctcttattttctaaatactttccttagtgtagaaagactcaagtctggccctactgaaaaggatatttatgacatcaaagcatattgatggcctcatggaaatacagcctcaccagttagaagatggtaccaggcattacctcttacatctgtgattcaatgaggaaccaagcaaggaatcttcagtgcaggccccctcagatggattctctcatctttgagatctaaacactttgttttgtctcctttgaagaaattacattcttaaggaggagggcaaagggtgagatgggttagggggcttcctttgggtgtctacttcactttgttcatgcccagagagtgtctgggcaacacaccactgccctcctgcctctcctccaggcacatcctagccttcgagtttttcttatgtgccacacatctggagtgggcacctgggacatttgtgtttctatttttcccatccaacaggaacagccccctgttctgaggcacagcagcaagtgaggcagtctcaggcattcaggtgcattgtcaagatcaaaccaaatgcatggcctctgtacctgtcaactgcctttcagtaaatactaaggacggttttctccctttcgtaatctaccatcagtgtctcctgtaagtcttaaaaaatgctttgaaatcaggcacaaccccaaaggatggtccctttcacaccccactgcatcgaaccagctttacgtgtttgctgaaagtcacatggtgacagatctaagctgaaacctgggattcaaatccaggccagatgttttgcaaagtaccctgcactcctgaactcttctgtctagaaggtgacagaagcccactgggcatgatccaactcaggtaaagggaaagtcacaccatggagggaatctaacctgtttgccatcacacttcgcagatattaatttaggtgaccccaggagcaagggagaattgagtttgtgcagatttcacccatgcatgcccttggctactttgccaacaaggagtaacttgtacagtgcagctcagtggtgaggtgtccgttcatccattctccacctcccttaatattcactgagcacctcccacttaccaggcactgcaactggccctggagatagggcctttgtggggcttatgttccattcagggaagaggataataagaaaactttttatttttttatttttattattttgagacggagtcttgctcttgtcgcccaggctggagtgcaatggcacaattttggctcactgcaacctctgcctctctggttcaagcgattctcctgcctcagcctcccaaagtgctgggattacaggtgtgagccaccatggctggccagtaagaaaacttttacataaacatgcaatataatggcagaagggaatgaatgaaatcaagaaaaatcaggccaacaggagactggcagtcacaggtggagacgagagcaattccagacggaagtgctcaggactggcctccctgaggccatgacattggcacggatacttggtgaaggaaaatgatatggaactacctggaattaagggtttcaggctgagctgacgccaaattcaaatccctgaggcaggaccgcagggtgaccagatggctgaaacaagtaacaggagggaacccacagaaattgctgtaagcagctgagatttaatccaatgccaacaggcagagactaaaggagtaaggcagacctgcctgagtcctaacttggcctcttattagcctaatgcccttggaaaagttggtggacctctctgaacttcatcttcctcatcagggaaatcatgagaaagatgtccatttgcaaagattgcttgagatcacgtttctaaagcatttatccaaatgcctcctgtagggtaaaggttcactgactggtgactgttgctgttgttcttatatttctggctttaggtagcatgtatcctctgaggagctttaagtcattttttctattacctttagtttggctaaataaataagttcttgtcacgtctttcaagttcaagagctattcctttgggttggttttgaattatgtttgtggtaaagagttactctggttattagaatctgtattacaggccagtgatagctggaattttagatgcttaagggaacacgtaagacagccatataatatatggctcccacatgtttatttttccagataagagaattttaaaaacaaacaagtctatcatctatcataaatagtacctcatgaaggacaggatatttggaacaataatctccaagaagtggcaattcctccctagaaaggtcacctttcatagacatatacacacgtgtgcatatgtgtgtgcacacaagcaaggctgcatgtttgcctggacatcctctttctctctgtctctctccatacgtagtgtgtgtgtgtgtgtgtgtgtgtgtgtgtgtgtgtgtgtatttttctctatgtggcaaaataaagagctggggctacatactgctgtctcacatattttttaaatatttgtatttttaaatacaggtgtatttttcttgctttgctgtcgatccgtgaacatgtcctcatgcatagacctctgccagctcccatttacaagccctgctctggacaaaggagatgtgatcaatgccacaggtgggggagaagagctccctgaggctcagcctagccttggggaagttgcgatctgccgagggcagtgaagctgtgggcacctgacctgctggcacgataactctgcgctcgttcgtggtcatgtttgggggtggcatgtgcttctcctccatgtagctgccgtagttcatcccaacggtgtctgggctgcccaccatcttcccgcctttggccacactgcattcatcaggagagttcctggaggagaagaaatattcttccattataacagcaatcaaagagcatgtctccatcgacttctcacaatacacagagagaaccaaagaagggcaaggcggaagagactgggggagaaaggacaagtgtgaaaagccaaatacaggcggggtgccgtggctcatgcctgtagtcccaacactttgggatgccgaggtgggcggatcatgaggtcaagagatccagaccatcctggccaacatggtgaaaccccgtctctactaaaaatacaaaaattagctgggcatgcctgtagtcccagctactcaggaggctgaggcaggaaaattgcttgaatccgggaggtggaggttgcagtgagctgagatcatgccactgcactccagactggcgacagagtaagattccatctcaaaacaaaaaagaaaagaaaagaaaagaaatgccgaaaacaggccttgccttctgtcctcccgaaatgcatattttgaagccctaactcccaatgtgatgatattaggagagagagcctttgggaggtaatttcagtttgatgaggtcatgagggtagagtcccacgatgggattagtgcccttattagaaaagaaagagaccagagctcgagctctctctctctctctctctctctctctctctctctctgccatgtaagggcagagcaagaaggtggccaggccatctgcaacccaaggacagagacctcaccagagactggccctgctggtgtctgattttagacttccaacctccagaagtatgcaagctcgagtcccattgtttcagccagccagtctgtggggctctgtgaaggcagcctgcacaggctaggacagtgcccatactggctagatgcacagaacacgcacaagggaggcggaactaccacctggcttctgtttcttaagcagctcctcctgaaactgtcatgtcaaaactccatctgtgacaactgattggggacacttgcagggaacagtgaactgctctttgttctcgcggtgtgacagcaaacaggcagagtagacagatgctgtggggcggcaccagggacactcgctgctcagtgaggtttatcctggaacgacgttccttctcaaaacctcagaatgaaatcctcctgctcaatttcaaatccctgcagccaatctttacatatggagctttgaagactcacagtgttccaggcttaggtgtagacaggaagggcagggaagggtgaggactgacgctaggggaggcctcatggggagtggactccagcagtcctagaggacccttgggaaagggatagggaaggaactgtgtggatgcagagaggggtcagctactgactactgaccgtgggcaacaggtcacagggctgctgttagtaaggcagtcactgtcatttggataaagtcaaacctacctttctggaaaaagaaaaggaaaacattttaaacagtgagttgtgaaagctacaggacattggtgaaatcgcatctgatagggaaatgctaaaaagaaaatccagcttagggccaggagtggtggctcacacctgtaatcccagcattttgggaggccgaggtgggcagatcacctgaggtcaggagttcaagaccagcctgatcaacatggagaaacccagtctttactaaaaatacaaaattagctgggcaagtggtggtgcatgcctttaatctcagctactcgggaggctgaggcaggagaatcccttgaacctgggaggttgaggtcgtggtgagctgagatggcgccattgcactccagcctgggcaacatgagtgaaactccatcaaaaaaagaagaaaggaaagaaagaaagaaagagagagagaaagagagagaaagaaaagagagagaaaatccagcttaagcagaaaacagaaaatacatgtcagtgccttcttagatggttaacacgtagatggtaaacccagggtcactgtagctgagaagtattaatatttagggtctgttgtctaaggcggatttccagaaatgcctctcaggctctatccaatgcatacatttttttcatattccttggaatctgggaaccttcgctttctctagattttagatttctatcccagtgtttctggttgtgggatccacgccaatgaagcctcatttatctcctccacttcttgttagttggagttctgcagagaacttggacaatcaaaaaactatgggcttggcatggatgtgaacttcaagtctaaggaggtcaaaaccatctgaggcaggagcgcactttctgagtggggtgagatggagaaggtcattccacacctgaaagccatagctgggatgtggacaggaagggaaagtgtttgttcagcatgtgggaacttgaaaatataggtttgttctcagcatcacttacaaatgtgtctgaagcctatggagggatcttaggtgttggcagtgaagagggtacactgccatctgcggatggaggttacagtcagggtcacgcaggactcaggccctaacatgggcctggaatgcacagccctgcctgatggcatcctcacagctgtgctaacatgaaggaaattttaaaataataatggtctgagttcccatgaagtagatcctgaatatttccaccgctgcctacacatgcattatttcctcttgatgctatttttcctggcttcacacatttatctctaaaagacccatcctaatatgaaaacacagagtgtcttcacttagactgagtttcctattcctctggaaaattccatcagttgagtagagtgtatatgttttggtatatttgtctcaaggagagaagttaccagggaagagaagttagagggattaggttctttaggaaaaagactttgcccagatgatgtgagtaactcaagtaacaactataaaatctagacaacctttgttcagattcaatcattcactcatccatttagacagctgttatcaagtgccggccgtataccaggtcccatcaattctttcttctccaacaacgcagttaacaatttgaaaagtaaaagatcaaagagatgtataaaattatagaaacaggccaggtgtggtgactcacgcctgtaatcccagcactttgggaggccgagctgggcggatcacctgaggtcgggagtttgagaccagcctgaccaacatggaaaaaccctgtctctacttaaaaaaaaaaattagccgggcgtggtggtgcatgcccgtaatcccagctactcgggaggctgaggcaggagaatcgcttgaaccagggaggcggaggttgcggtgagccaagaccacgccattgcaccccagcctgggcaacaagagcaagactccatgtcaaaaaaaaaaagaattatagaaacaggggacattgaggattttgaacccttcagaccaacccctttttcattttcttttagttctttctagtttaattttcatatccgaggacaagaactctaggcatagatcacaagagtttctctgtgacattaaagtagatccttcaggctggttgcggcagctcatgcctgtaatctcagcactttgggaggctgaggcaggcagatcacttgaggctaagtgttcgagaccagcctggcctcccaagtagctggcattacaggcgcctgccaccacgcctggctgatttttgtatttttagtagagacggggtttcaccatgttggccaggctggtctcgaactcctgacctaaggtgatccttctgccttggcttcccaaggtgctgggattacaggcgtgagccacttcacccaggtttctcttgcaaattttaacagcaaaagagtagccttaacatgtttgggatctgttttgggagcttaatagttatcagtcttcaccacagcgaactgtgttgctggcattgtctccactttccagaggtgtgaactgagtactcaaaacacaaggggctggctccaggactcacagccaggaggaggtagaatgagacttcagtgcgggtggcccgaactctccatccctgcttcttaaccctgaacagaatgactccacaaagtaaaggcaagacaatgtcttttcaaaggtaactagatcttcatttcaggaaggcatcagggactccctgacccatacactactctggtttaaggtgtacactaaagcactcatcctgacatactctcctaccctgggactgttcattccctgaaaagcatgtgcatgacacaaacagggcacatatacaagatgcaaataagaaagaggagtgattcctggagaagaaaagaattttcagagatatctgctttacttaagaaaaggacgccaggcacagtggctcacgcatataatcccagcattttgggaggccaagataggtgaattgttttagctcaggagttcaagaccagcctggacaacatgaaaaatgtgtttacaaaaaatacaaaaattagtcgggcatggtgtgcacctgtagtcccagctactcaggaggctcaggtgggaggatcacctgagcctggggaggttgagactgcagtgagctgagatcatgctactgcactgcagcctggacaacagagcaaaaccgtgtctcaaaaaaaaaacaaaagagagaaaaaaagaaaaggaaattttatcacaattcagagaactgaaaagtgttcatttgaaagtctcactataaatacatttctagctctgtgcccaagaaaagatccacactgcacaaatgtgtgtcttgattactccactgcaaccccaccttcaccaggcattccgaggctcacacatcgccgggaaaaagttcccgcaaacagcttggtatgtcacctgcaccaagcgctgcccagcatagaggaccacgtgttctccattctcacatgataaggatttggacgttcaatgcattgttttattgtgcacatgacaaagagtatgctgtgcagggaatgaacagtcctgaagtaggacagtgtgtcaggatgagtgctgcaatgtacactttaaaccagagtagtgtatgggtcagggagtccctgatgccttcctgaaatgaagactagttaccttttaaacatacacatacttttaaacatacacatacttgcatatgtgtgttgcagcagttcctgagaatattctcaggctattcagcaggtgcctgtcaaacagataatcatttagtaaatattaaatgtatctgtctttttgtttggggtggaaatttctttattgcaaataagcgtggttcaagatattgctctcacagactcctttgaggacaaacaaaaatcattttgtctttttatttaatttaaatagttttgggggaacaggtggtgtctggttacacgaataagttctttagtggtgatttctgagattttgttgcacccatcacccaagcagtaaacactgtacccagtgtgcaatcttttctccctcacccactcccatgcttcccccagagtccccaaagtccactgtatcattcttatgcttttgtgtcctcatagcttagcttctagttataagtgagaacacacaatatttggttttccattcctgagttacttcggttagaataatggtctccaactccatccaagttgctgcaaatgccattttcttccttttcatgggtgcatagtattccatggtgtgtgtgtgtatatacacacacgcatatatacacatatacccacacatatacatatgtatatatgtacatatacacatatatgtatatctacatatgcacacatatacatatataatatgtacacatatacatatatatgtacacatatacacatgtacatacgcacatataaacatgtgtgtatacatgtatacacgtgtacacatgtacatatacacatatgtgtatatacatgtatgcacatgtacatatatacatatgtgtatatacatgtatgcacatgtacatatatacatatgtgtatatgtacatgtatacacatgtacatatatacatatgtgtatatgtacatgtatacacatgtacatatatacatatgtgtatatatacatgtatacacatgtacatatatacatatatgtgtatatatgtatatatgtgtgtatacatgtatatgtgtgtgcatatatgtctatatatatgtgtgtatatatatatacacacacacacacacaccacattttctttatccactcattggttgatgggcatttaggctggttccacatttttgcaattgcgaattgtgctgctataaacatgcatgcgcaagtgtctttttcatttcctctgggtagataaccagtggtgggattgctggatcaaatggtagttttacttctaattttccatactgttttccacagtggttgtactagttccatagtggttgtactagtttccatgctgttttccatagtggttgtactagtttacattcccattggcagtgtaaaagtgttcccttttcaccatatccatgccaacatctattttttttttatttttaatgatggccattcttgcaggagtaaaatggtatcaccctgtggtcttgatttgcatttccctgataacaagtgatgttgagtgttttttcatgtttgttggccatttgtatttcttcttttgagaattgtctattcatgtccttaacccattttttgatgaaattatttatttttttcttgctgatttgtttgagttgtcgattctggatattagtcctttgtcaaatgcatagtttgcaaatattttcttccactctgtgggttgtctgtttgctgattatttcttttgctgtgaagaaagtttttggtttaactaagtcccatctatttatctttgtttttgttgcatttgcttttggattcttggtcatgaactgttattctcaaatttacattttcagttccaggttctatttgtcacccacagacattagtcttgacagtcctatgcaatatgtggcatcaacaagagtaaacaggagctgggaagacagatacttccctctgctcacagcagcagaaattccacattagccagggggccccaagaggtggggggctggttcagaattctgagaaagaactgaacaatagcccaatggctgggatattaaaaagccagccataacacctcacaactccctagcaacacccttggggccacacagcctcaaactcctgagctcaagcaatcctccttggttcagcctccctatgaatagctgggactacaggccacactccttgaggagtgtaacctctgcagcaatctcacacttttccatggcatttggtcataactgtggtcactcacaggaacacagaaatagtgtaggaagacaaccaaacattcatgatggaaataaaaaaaaccagaatgctggtgtccttcttctagtaactggagacgtgcccaatgaaactggcttgttgagcttcaaacaataatctcccttaaacagcagttggagaattaagttctaatcatttaaaatcatgagcactgacttcttaaaacatactagtattctgaattaatgagaaaaggacacggcaaagaatatcaaatacattggaaattttgttaaatttgagttaaggagagaaggcagacacgttgctaagcccagttgggttctcatagggttactgaatcagagggctggaagaagccccattttcaagcccccagacatgactgtctggaaaccacttggatgaacaagagtttagcttcgttaacagttttttagggaggggcttcgtaattttcctctgcaactccagagttctatttataaatatgtatagtggttttaaatagccattattcccctacctgtgtgcaagctatgtgaagtttggggtggcttataaaaatacatataagacaaaatgataacataaataattaacagaataaaaatgaggaaacaagggccaaaaaggaattaagagatgaaagcagcccactgagtaagcttactatttatcctgctgaggtaggataccaattcaactctgagctttctactagccaaagcaaagacacaagtgcatctgatgacaaggtttgaggtattaataagctacatacaaaccagttattcagcagaaataaagctctccctgggttaagctttgagagtttttctcggggcttctcatgaagaaaactggattatgcagtaaacaatatcgttcccaacatctcataatacatctaagaccatcccgcaccgtgccaggcgtagctggtggcagagcaggacgctccctgcacacagtgctcacatgctgcagccacagaggatgagagacggcatgtccccagcctctcctccttactggctgccattggaaagatcagacctgtcagagaagtcaatgcaaaaacatgaaaaaaacgtgtaattaaaaaaggagaaaaccttgagagatgcagtgttatacatgcctctagtttcataactcccaaatttctagatttgatttgattttattgttttttaagagacagggtcttgctctgtcacccaggctggagtacagaggtatgattatagctcactgcagtctcaaactcctgggctcaagcgatcctcttgcctcagcctcccaagtagttgggactacaggcacgtgccaccacacccagctgttttttaattatttgtatagatggggtctcactatgttgcccaggctggcctctaactcctgtcctcaagcaatcctcccacctcagcctccccaagaactgggattgcaggcatgagctgctgcactgaaacccctaatttctagattttaaattcaaatttaccaacactaaatagggtcatgtttatgtctcccaagagcaccaaatgcactgtgggtaaacaactctttccaggcctcagttggttaatcttccaaccagtatttcactgttgactaatgatgagcatggctccagactctttccacgtgtttatgttataataaacatatggataaagcatttaacatggtgcctggcacatgaccacgccaggtgtcagctattgctgttagttcatttcatctgcacatctccatgacagaaatactcgaaagcaggagccttgttacagatgaagcacagagaggttggataacttgcccaagatcacacagccagtagtggaagaattgggatttgaacctagatagtcatggtctcgactccaagtacttcaccgccccactctatgcccttgcttggtaaatccgtgtgaggagtctttcatagacctaaagcaccattgaatggatcctcagaaaacttaatttcatcactattaagtattctaaaagaacatcttcagagtggccctgaagacagtcatggatgagggttacagacgtgagctgagcagggcagccacgaaggagcaaggcagggccccgtgggagacttggaaggtggcaatgtttatgtagagatataaataggttttgataagtttggtctaaaagaaatagtcatctcaatttgcagttaagcgttctatgcttctccccaaaacttcattgctgtgcccagcagggtgcatgttttacacagatgatgggcaaacattcttaagtgcaaaaggaaaccagacaaaaagtccccatgacgagacagccgagtgggagtgcatctgactctgactgcaggcccaaaaagatggaggtgaggaccaggacaggagctggaccactggggaagcagtcaatctaattttttaagattaaataaaataagtccaagatgaaagcctccttgagctgtcgtccatacataataccccttaaacaaaaaaaaagcggggttggtggtggggactaatattactgaaaaaacatactgagaaatgtaaaatttggtctttagtctttgaaaaacaaaataaacttggcatctgactttggttttctcacatcagagtctacttacagcgaggcaatttccgtcatggaaagaacccgcaatgaaatggcacagccgtggccattagcttgacaagcatggagcctcagcccttgtgagtgtgaatgggcctcatttatccaagaacggcactgaatacatcccagaggggcagccccaagctcgctggccacattaaatctgattcaccctcacttcagaacacttagcaggggcccactccttggagaaagtccaaggcaagtcagaatgtaattgcggaaatcaatatgtcttcttctttgagtcagtggaggcaaacccgctaatcctgtcgaaaatctacctattcttctagagccatcctccttcctaatcctctgaattcctcttgcacctggacacgactttccaaccccttgttctccatcacatgctggtgaaatgtccccgaactcttccaaagctttctccctcctgctaccagagtgctctcccccaaacagaaatgcaagctgcccatgtccaacctaacccccatcatggcccagagcccctccctagattctcctcagtgatctggctctggagcccctcaattcactcatttgtttagcaaatatctgtggagcatctttctaggccaagcactgccccaggtactggagttatatcagtgtctctattaacatggggctggcatttgagtagccaaagcccctctccccaactccatgtgctctgtgctcaaagaccacattccacatcaccccctagtctcttcccttcaggccttcacttttgctactccctctgccttcaaggcctatgaccacctgatacctgccctattcacctgttcaccacctggtacctgctctattcacctgtccatgctcacctctaggttctctacaagcctttcctgggccgccagagaggaatgtctcccttccaattgcaccattctctgtattttctcagtaagtgtctgcaggatgagtgagtacatttatgaatgaatcttccatttaaatattgagttccttatctcatacctgcagtgcaagagaaagcccctcgtgttgcagtcagaaaaccattgctgaccttggttgaccttagatgggtcacctaacctttcgaggctcaactccttcattcataaaaatgaatggatgctttcttgaggttgctgtgaggacatccctgagatgatgcctgtgaagaaagtctgcaaactgtgaagcactatacagattaacacagcaacatactgcatgtgcatggctgtgcatgcgtgtatgtgggtgtaaatgtgaggctttttgttcttggcaactgttcataactgtacctcggtgaactcttaggtaggtcaggaagctaaggtttactattgtgcagtgttcagcatgcaactgctttttggaatgtcactgtctttctgaatgttccttttggtttattaggttagttcacattaagaagaacttggtgaggaagccacatggaagaaatggaaaggctttctttggcagctctaccctaagagggcaaaggggtcagttctgcgagagaacccccacaaggaggctggcccgggacaagcattccaggcctgtctcaagtctgaatacaaataaatcccttctcaggtggttttcttcataaggatcctaaaagcatatacttagtcctaatcgactgagcaagctcctaatcaagtttcatagtgtgaatcggaggtcagtcaccacaaaaggtatttttaggaccccagacaaggaggggattgtctggagcgctgcagggtaatttgtgggtctgttttatttctgaatcagaggcagtggaaaagctgtttcagaccccatggctggagcagcgggtggagctcagcagtgattcatgtagaactccgggctcaaactgaaaccgtagatgtttgtcttcacagctgtgtgttatttttacccttactaaatattctctcttacacctggaatttcagcctcttcccaacagtcctgttccctcccccttccctgaagcagttgaagacaaaattaattaaaaagtcaccaccagctcaccaacagttagttctttgtccccttaaaggggctcgatgtttccctgagaaagtttcattatttaagtttatatttctctttacagccaaaaacgaatgccagcaagaccgtgttgcttttagatcttgaaaactggagggaaatgcaccattttgggattcatcatttgaaaacaaaatgttctgtagcataagatctctacaagcagttacatgacaaagatcagatgtgacatcttttctatcttgtgcacgtcttttaatttgtctgaaagactcctttttcagagaagaaaggattgagcccaatagccagtatggtgcttcatgtttttataacaggccaggtgaatcctggtaaccaaaacaattttactttctttttttcttttttttttttttttgagacggagttttgctcttgttgcctaggctggagtgcaatggcgcgatctcagctcactgcaacctccgcccccactgggttcaagcgattctcccgcctcagcctccgggattataggcacctggctaattttttttttaatatatatttttagtagagatggggtttcaccatgttggccaggctggtctcgaactcctgacccacctattatttttaaaatgtgattgttttggaaacacctggtgaggttaatgtaaaggtgagtgcaggtgaactgacctgatgtgataaagtaagatagtaataaatgtttctaaaatgtgtaacatatacaaaaaatcaaaatgcagttggcacttggatttggtgcatcttgtcactgcttgtctgacacgtggagagaaccttgctatccctctcaatgcaggaaagacgttcagcttcttctaagaagccctgagggagtgaagaagagtccaggcctgtggtcaaatggccaactttcactttcactaactttcacttgagcaagtgacgaaaacttttggaaactcagtggtcatccgtaaatgtgaataatcataataatgtcatctcatagatgtttgagaaaactggacaatatgttgtataccaaaatctattaataaatcatgtgggttttagaaatatgggttaatattatccctttcagggtctttttctcctgcccaggtagagttgatggtaccctcatatctgttattgctgggccctgaacatcgctctgtactgaatgtgtcttatgatctcacagaatctttttcacctttggtagaccatgagctcctcttagttccttttttttttctttctctcttttttttttttgagacagagtcttgctctgtcactggagtgcagtgccgtgatctcagctcattgcaacctctgcctcccaggttcaagtgattctcctgtctcagcctcctgagtagctgggactacaggcacctgccaccatgcccagctaacttctgtattttttgtagagatgggggtttcaccatgttggccaggctggtcttgaactcctgacctcaagtgatctgcccacctcagcctcccaaagtgctgggattacaagtgtgagccacctgcacccggccagcttcacttaattcttaatccatctccatcgaagctaacacagtccatgatgcagattaaacactaaatacacgttggtttcctgcagcatttgtcaacttcgacactagtgccactcggagccaggtcactctttggacaggtgggggtgggggctgcaggggcgctgccctgtgtactgcaggatgtccccggcctctacccaccagacaccagtaacacctcccagctgtgaccagcagaaacacgagcattggcaaatgcctctgggggccacatcacgatggttgagaaccactgggctaatgaattaagatccactgagctcaggcaaggaggcaagagcctcttgttttacctggtgtttattagagagaagttcctgtccccagtgtctggggtgatgcttaaaaggggcccttaaaggggcctctatgctcatgaggattcctagttatggtttgtccgtaccttgtttggggtacattccccaagccttggcccatcctcgcttcctcttttcctcatgccatatgtccaacccatcagcaaagcacgttaattccaccttccaactatacccaggatgcgactgcctctcccaccctcccttgctaccactctcacccactctcacgcagatgtctcccatcctacacccacattttctcaggaagacttcaacacaggagccagagaggccctgcaaaatctaagtaacactatatccctcctttgcctcaagtcccctaatgatttctgaactcaccagaaagtgaaagtcaaagtccggcaatggccccacgggctctccaaactcatcatctattactcttcttcttggacactaaacagcagccacgatggcctgcttgttgtcctcgaacacctcaagctgacctcagggcctttgcatttagcattccctcctcttggaatattttctgctgtttaatcacgggcattctccctcaactgcctttgcagctttactcaaacatcacttttttgtgatcttctccagccaccttctttagagctgccatccgcttcacgtctttatttttctccttagcatttaccatgatctaacctgctgtgttttcataagtggtctgatgtcatgaccatcttcactgctagaaagtgaacttagtgaggcaaaacttttttgtatattttatcactctatcccaagagactaggaaagtaggtgctcaataaatattcattgaatgaatgaatgactccacgcataaacagtatgtctaaggccctgatggacccagcagatactccctactttttctcatctccatcacatgacaaatggcatgttttttaaataacatctataaaacatcctgctatctgacccgaggctggagttattcatggcatgcaatgaatctatcccagagagaggcaaggcccagatagcattgtctctcgctgcacaggcccagctgggcaaagcgccaatgtggcgggagggaaggaggtatttctcaactcaggcaaggacttctggggaacaaccccacctccgcgtagatcctcccagatcattcgctgggtgggtcacctttacccagctgctgggctttctcatttttcatctccttggatcgtgcaacagagcagtggttctcagactaccaggcatcggaatcccgcagagggctccttcaaacacagcgtgctgggctgccacccaggtctcttccgattctagggcagggcctaagaagccgcatctcaaacaagctcccaggtggaggtgatgctgctggtcccggagcccacgctgagaatcaccacaccgggggaaccctcactcaacagaatcaaacatggcaatggctccaggtggcctgcagactgggctgaggggggactcacagcatggcacataaattgactgagttccacctgcagtgagcctccaggtgggcttcacgaaatcgccatcgcctgtggaaaggggaaggtgccacttagtgtaagctgcctgtgatctggctggcctgagctggggatgctcagatggaggaaaagcagcctgctctgcacagacctgccagcctgctcacgagaagacagtttgcttgtggaccatgagtgagcaggtgttacctcttggcttatcctgctagtctatcatgacttgagctttggggacctcacagcaaattcagggcattggtagggagctcacgagaggctgagcaggcgctgaaactcccagccaggcccttggtgtggatggcacaggaaaacagctggttttagtttggccacacactgacagttctccattgtgtgaacacttggggctttctggtgcgtgaggctagagtgaagaaagggagagggtggctgtggaccaccgaagctgaaaaatgatgtcctgtgtctacacaacgtgcaattagattactgtctgcaagaatgctgctgtttgatctggcagtggccaagccaaacccacaaggacatcccagttggctcgcaaagcagtggttcctttctctcctgtttttcttttattatgctttacagaaactctattataatggcaacagatctcgtttcaccacttgtatttcatttcaggagcttgtaagcacgttaggactgaggttttgtagaattccactattcggttgggaactaagtccttcctttctctcaaagcacatggcctttttctccgtgggtactggatggatagggatggacagagggcactattcccaagctgggtattctaggcagaaggaggtgggccatgttctggaaagacctaagctgcagagagtgcacttctcccgtggaggtgtctgcaagatagtcaggggccacaaaggtaacagcccacaagttctagccaaagagtaatatttgacttacgtaacttccccttggacttgacttcaagtggcatgtgcactacaggaaagcccattatgcataagctaagaggagggacaattagaagaagctattgggccaggggccaggagatgggctaactccctggcacagctggcctggggcttccgagtctggaaggatgcaggtgcaggtagtggagcgttgaggagctgcactcctggcggggctcctccagaggcaggcagccacacactgctctgcagcatctcatctgtgagcccctccgtggcagaatctgcgtctccgtgaaccctgcctctgccctggcccctcgagctgggctgacacagcccggtgctggttcacggtgtccaaaataaagcagagtgaatcacgcccatgttcccttttatggagctgcacctgacattcgtaaagagcccatagtgaggccgggcatggtggctcacgcttgtaatcccagcactttgggaggctgaggcgggtggatcacctgaggtaaggagttcgagaccagcctggacaacatggtgaagccccatctccgctaaaaatatgaaaactagccactcgggaggctgaggcaggagaatcgcttgaactcgggaggcagaggttgcagtgagccgagattgtgccattgcattccagcctgggtgacaagagcaaaactgtctcaaaaaaaaaaaaaaaaaaaaaaaaaagcccacagtgagtcagcaaagcctgcggatgggatcccaggcagtcctttgtctgccccaaggctgcctccaacctctggctgagatgagtcttagctccactgataactgttcagctttcttttcccccattccccttcaggaagcccgttggattgttaatagcagaacactgactcaccacttatgtttcaattctttcagatcactgagcttgagcagccccctagtgaacctctgacctgacacgccaccccctttaccacccgctgtccagtcaggctgagctccagcagcagcggtgaactggccccccagagcacactggtttggagatctaaaaagtacaatgggtcaccagtcactgatgagtgcagcatccctggaagtcaggtgtgggggtcagtttcctgtgtcaacttggccaggccgtagcacccagtgacttaatcaaatgctaactgaggttgtactgggaaggcatttgcacaggtagctagtcagttgaacttgactaaaggagatgatgtcagataatgtgagtgggccttgtctaatcagttgaaggccttaagaacaaagcctgcggtttccagagcagaagaaattctgcctactttccagcctgccagcctcccctgcagatctcagacctgcccactcccacaactgcattagccaattccttcaaataaatatcttaaaatgtaaaaatatcctataagttctatttctctagagaatcccaactgatacaccaggccagcacccagacacaatgccaggagacacactgagctctgggggagacgggcatgagctctgtatctttctcttctacaaaggggattagtgtcagccactcctctccctccccctggaacatccttgtgggtaggggacgatgacacttggtgactggttgacatctgtacattgctagatgcctcaaagcggaggcagcctctgcagccagtgttcctcccctgcctattacaacccagctgcccttttcctcaaaggaggcacgtaggcctggattgaaggcagatgaggtccaccttgttcccttcatgaacagcacctgccaaaccgacatcaccgaacccaccggaggacccggaggatgaagaggatgacatgatggtcttcactcggtatccacccaccaaaacacatcaccgatgctttaggagctggaacagcattgaaagtttatgacggcagcaatctgggcaatgttagaattctatgagccctgagagaggaactcttaaagttcccattgtttccttgaaagaaaatgtcaaggccgggcgcggtggctaacacctgtaatcccagcaatctgagaggccaagatgggtggattgagttcgagaccagcctggccaacatggtgaaaccccatctctactaaaaatacaaaatttagccaggcatggtggcggatgcctgtaatcccagctactcaggaggctgaggcaggggagtcgcttgaaccccggggggtggaggttgcagtaagctgagatcgtgccacttccctgcagcctgggtaaaaaagagcaaaactccatctaaaagaaaaataaaaaagaaagaaaatgtccagttcccctgaaaaagatgtttcccggaaagagaccctcagcgcagcaccagcctttcacttgcctgacagaaaaaccacccaagagctttccccagtctgctgcgctgagggccctggggcggaactgccctggtgtctttcttatggactgaagctcctggtgtctttctttcttatagactgtagccccttgcctggggctcagggttaccccaaactcccaacctgtacccctggggtcacaacacaggctggaaaagcttccccatgcctggccaggagggagaggagacatcagctaccaaggggcatcacaggctcacactaaggaaaacagtgtttgcacttctcccacaaacagaatgcttatttttttattttttatttttatttttttgagatggagtttctctctgtcgcccaggctggagtgcagtggcgcgatctcggctcactgcaagctccgcctcccgggttcatgccattctcctgcctcagcctcccgagtagctgggactacaggtgcccaccaccacgcccggctaattttttgtatttttagtagagacagggtttcaccatgttagccaggatggtctcgatctcttgacctcgtgatccacccgccttggcctcccagagtgctgggattacaggcgtgagccactgcgcccggccagaatgcttattttattttaaattcgggagtaacacagtgagaacaatagaaactttcatttctggagcactgttctcgcctcctcactcagtctcccttcggaggcttgctgaatccagactggccccaggccagactctcaaacaagggccaggacatggctcactctgcctgttgtccatcggaaatcatctcagtgcccttttgtctgagatgtttccttcctctctccccaccttccaacatccccctcctccctgcaggtgaattgctcataggtagaaattagcctctgcagaagaaaagctttagaaatgtgtcccggtcttagtgtctccgccgtgatcacgctggcatatatgggatcatatgaccccacccaaaacagaattcattcagtgtttccaggctgtgttccaccaactgatctactgcataaacactgctgcattctttagaacatgattaccctgcattcttctgtgtttcagaaatatatatagttaatgatcaacagaaacattgtatcaaatgcataggatttatgggtaaaaaatatttacatgtaatcattaatttcccacaactttggtgtcctggacccatcattgcattttctatccaggtccttctgtaactccaggaatgaatctcttgatgagattcaaaaatatttacatgtaatcattaatttcccacaactttggtgtcctggacccatcattgcattttctacccaggtccttctgtaactccaggaatgaatctcctgatgagattcaagatgggcctgcctcgagttccacttaaaggaccagtgcggtggcaatatgtagcatcagagccagtgcactttcaagaagcagatgcacagacgcaaactgacttctcagagtggaggagtgttctggcatctcccatctccccatctggcacgtccagccttgccgttgacattccctctaggacactgtgacttggcaccttcattaacaccacactaggaattgacgcaaccgtttccagacttataaactatgacacttataataaacctttttagcgttaaaacatatatgtaacaaaaaggccccattacagcttcaacagagtggaaaatgctcagggtgtggagtcaaacactcctggtttaaatccaaactctgattccatttaagtggtgatttggggtcagactggaaatgcctgatcacaggtttcttcatccatcaaatggggtcaagtatacttcatgaggggctgctcggaggactgaggggctactggatataaaagggctttgtacacagtaaagtttccgaaaatgtgagctgttcttatgacctgatggtagattatgcaacatttcgaagaaataatctgttctttatcctaagatttgatattctttttcctgaatatatatggggtattagatcataattgaaattaattttacttttcaaaactacacagaattcaacactttttgagggccagggacagttctgcatttggtaatacattttacgtgacagttgtatgttcatgacaaactcagggaagctaataattatgggagacactggagagggctttatgtgtaagctaagaggaggaaaaaaaaaaaaaacaaacagcaggcattaagagaagaggaccgcagagatcagagggtggggtgagggtggagggcagacaatggagatccactagcaaattcaagtggcttggacatacgccgcactgcctggccactagctgacactctccctttgtgaaaacataagacggcattattttccaggcaatcaaacctcagatgaattctgccatatgtgggcaaggctcccctcccacagagccctcgtgcctgggaaatagaattgaacacatcttcaaagagagttcttggtaaatatactactaattttacaaactccatcctctacacaaaccactggagaacacattttcccagcgctgtccaacgtcaccgttcaatggcctttctttctttctttcttcttctttttttttttttttttttgttagccagagtcttgctctgtcgcccaggctggagtgcagtggcatgatcccggctcactgcaacctctgcctcctggattcaagtgattctcctgcctcaggctcccgagtagctgggattacaggcacagtggccttgctttctaagtcaatctttagagaagcatgactgacttccactttgcctttgcaaaggataggaaaatgggaggtcagggagagaaaggggcggaagtctccttaccttgagccattcacctggctagggttacattccattttgatggtgaccctggctgggggttgagacagccaatcctgctgagggacgcgtgggctcatcttggaagtctgtccatagtcgctggaggaggacgcggtcatctctgtcttagccaggtgtggcgttccgtaggcacactcaaacaacgactggtcctcactcacaactgataaggcttcctgaatgcccaaagaaacacataattcaagacactccaacagacagtcatgtttcaaaaagttgttgatttcagagtcctttctaactgggaccacattttagatcgtttttatggtctccatttctacctttcagaagaaaaaagtagcttgtttttctttcctcgggacagtaagagttagaaatgccagcctagaaaaacttttatgcaggtctcgaagcatcccaggcttgactgtggcagggcagcagaatatccactttaatctcaacttaaggaagttgaatttcaaaggtcttagaagacatccaattgcatgtgtcactatttgacaaatgcaatctataattcaagcagacagggtacagagcggtcatgaggattaaaaaaaagaaatctgaaggccaacacctaagcatctggcaaaattgccacattcctggggattttgcggaagagggacttagaggaagacagagggatcaatggagcaccaaagggcaaccaaccaaagatacaaacgtttccactctaagttattagccgaagtacagtttcaagtggtgcttccatgatggtgagcatctggatgataaatgaaccaaaaaaaaaaaaaaaaaaaaaaaaaaagctgtgaagtatccagatgcttccaaacagcaggatgtttaaaatatctggatcactgacaagctcttttttccccttactttcaattaatatcttcgctcttttgcatgatttggtgagaagaaatagcaatttgtcattgttggatcaatcatttttcgtggttttaagtcaaacaagtggttagccaatggctatgtttatattctacagccaatgagcaacggcaagtttgggaaatttcaacgacttaaatgatggcttgtgctgcaatgacacagagctgttgtgatacaatccaattttggttcttataacagacaaaaagaattccacatgaatgctcatttttatattagtcctttggcatcctcagtattgacatcaactagtgagaagcaaaggctagttgggccacacatttttatttaaaaaaaaagaaaaagaaaagaactttggaggcagagcaggggaggcaggggagtgtgggctgcgcagacccttccagtccaaacttgtcatctccaaatgagaaatctgagacccagaaaggtctagagctaatcttgaatgagctggccatgatcaaccaggggattagtgatgggaatgacttgtgtattaccatctgccttctccttgcccccacagccctatgatgccctttgtgacatttttttcctttgggacatgtgtttaaattagcaccctcttccccttctctgagatgacctttacataaataagggtgcttcccatcagtaatcacaccctagaagcagcccttctgagatggagagcttcctctccacccagaaggatcagaatttttaggaaacaatcacccccaactccacatctactctgtcgctcgatcctccacctgtcccaggaccaagttttttccttagcttcccaagtgcacaaacttctttgccagacacacggcactgagaatcagcaaggaggaagaatcaaaacaaactcaaacctctgtctctcaaagtggtggtcaggtgtctgtgctaaagcaaaagcccccatcctggactccataagtatctgtagaattacagccctgtgacaccctgggaaagactaagcctgctgtccaaacagtaatgcaaaatgtaccaaagagtcaggtaggccagacagagaaccagaatcaggcacaagggaaaaaagtcatcttgaatagacagcaaaatcaaactcatcaacaaccaaaaatgatacgaggcagtgacacagaagttgacagtacagaaacggcatcctagatgttagggaacctgaaattcatggctttctcttccagtcacaattgagtggccaaaacaaggaatctaaacacatagatgtgggtttcaaagtaaaatcagcaccatagacttagtcatgctaattaagacaaaaattagaccttattaaaaaatttttgcaaaacagatactcccttcccatggtggcactggctagtgtgttttacaggctcagaacaggaaacagagctgatggctgctgcctctctccttcctgggcctgagactcgaccaaggctcgcaggggaataacacactatgtaatgttagctttggctcacccatgatgagaaacatgaacaaatgtgtgatttatatcagaaattggcgaaaacaggttatatatataagaaacaggctaaatttaaaattacaaactaaaaaggaaatggctgcaacaataacaaacaagcaataactttaaagtattagtatttctccaagataaagtaagcttacttctgcaaacaaagccaatagccacaaaaatgtagtgtaagtttgaataataaaaaaaagaccaaaatattagaactaaaatgaagcttaagtgtgtgtttgtaggggaaggaatccattctcacatctggcaaagcattatttcagcacatggttttctaaagaaagaaatcaaagttaattgagatcgatttaggaaggaaaaaaccctcagaaatgctagagatgggggaggcatgcctcctttttttgcatcttaaaattcttctcacagctaatattgcacaaaaatgaggaagggaatataattcagaatattgaaagcaacccctcagttgcttttgttcattagaagggaaaaattctgaaaataaggaagcttcaggataaacacttcaaaagaggtgaaatacagtccacattttgaaaagacagagcaacccaaactatgccccaaagactttgttgattgtcactcaacaaaggctgctgaacacctaggatgaagtacagctcaggaaaaggaaacaaatgaataaagaaaatctctctcacatacacattttgggagtaagaagaagctgaggggttttcacagacccattcccacaacagcggtcactaaagttaagtgctgctcttcagaagcaaaccaaggcacagccctgccacatctttgtcctcccacttgacttggctgttggcaggtttcatcatcccttcggttaaagcttgaatggacacacgctgctgcatagggccctccctgcctggcagccctgtgacttcaaaggggagagaggatctagcccagtaggattaaaaccagaaaaagagtgctgaacacaggctgctaatcaggaccacatgagttctttaactccagctctgggagagacttcctggccttgactgacatgtctctccttccctgcagcctggctcctcctctttataactagcagatctcacctacctacttacctgcctgcctacctgccggccaaggtaggcagctgccttagttagcatgtatagattgttattgcagaaactctggccagccacaaggcttgggatctgcttcagtggctttataacagagaatattttaaacgtcaaaatctggcagatatgtggcataatcatttcatatgcctgcttctatgttactataaaaagacctgaactttagattggtgtttgccaatgtgtggggtgtttttttctgtagctccaggaaagttgggatattcccatcaggcaaatggcaggctaccaagctcatttttaaataacttacgagaaacacataattctaagcaaattacccccaaacaaaaggtactactgtgttagtactgtagtattgattatttcatttcaatacggaatataccaataacacatgaggaccattcctttggattttggtcatgggataacagttccagaaatgaagggaggtcccaccaggttatatttcatattataactctaaaatatgcatctattttcaagtaactagagtacaaaaaaggatccaaaatacattagaacactgaaaaagaaaactaacaaagttgaatgcatactgacattttcagcaaagtatttcaggaatcctgatgcctttctataacagatgaatactttgcaagatgcctatttctcaaccaaagtattagaaaataaaggcccaaaattgattctaatttgtgatccttatagctcataaaaatattacattgttaatacagagaatccatcatacttaacctcttttgaaaatttgggagtggtaaagtgttgaaactgagaaaatctttaagaatggtcaggtgaatttcacatctggagtaagcaaaggcatccatggtcctttcgtggttttcaaaaattaggaagatggccagaactaggcctctcgagaattggattatcaaacccaccttcaatgttttcaagtcttatatgctataattatttgataattatgaaaaacaaatggaacaactaagtggaacaagaattgtatgatcatgatcatgcttaaaaaaaaaaaaatcttggttcgggcatggtggctcacccctgtaatccaagcactttgagaggccaaggtgggtgggtcatgagttcaggagatcgagaccatacaaaaatccaaaaaaaaaacaaagaaaaaaaaatagccaggcgtgatggtgggcgcctgtagtcccagctactcaagagggtgaggcaggagaattgcttgaacccgggaagcggaggttgcagtgagccgggatcacgcgactgcactccagccgaggtgacagagtgagactccatctcaaaaaaataaaataaaataagaaataaaaaataaaaaaatcttaaagaagtccttgctgctatcacaacacagtgtggagatcattcacttaggaagccagcatcatcttcaatcaatagcctactttttctgtcagttttaatcccattacaatccaatacaaaacccttccttaaatttccctcacatataaccacgcagaatttggtacatcacttaactccctatattgccatcttttaaccactttcataaatagcttatccaccaaataaaccaggttaccttaagcactttcatgcaatatcctcttaaattctattttgttgattacaagatacaccacttgtcacattttatcagctctgaaatatgaaaatgaaaggcttatcctaggtatcaggcagcatttcttcttctctgatggcagataaaataatgggacattttatatccaatgacatcttacattttatgaaaaatgatcatttaatccttacaattgtcctataaggtcagctgtgattcttgcccacccatcagaaagtgcgattagagaagtaacatcaacagtgaggatgaggcagaaacagggtttgtgtctgtgaatggaatcattccccaaggctgtagactggccactacctggctgttactggaaggaagaagttggattaagaaaagtcacacggtggagtgttttggtgcctgctcttgccatgagagatggaatcacctagagagagacagagagagagaggctggtagagggaagagacagaagaaagatgaagggataagtgtccagaatccctggatctgggatggaataaaggatctggatggtaaacggagagtgctgggaaccagtaaggacttctctaggtataccatgctcttctatgagcctaggggatgtgtagcaatgggccctgcatacagttaatcatttcttttgcaatggcttaaatcaacaaccttgttcttttctttgattaatcagattattcagacacaaagacatggccaggtgttgggatgtgttcattgcaggtggatgcctgccttctcttaatgagtactatgcaggaaaactaggacaggtaggagtaccatttataaatatgctggagcctatgccactttgggcggcctttagtggatgtctgcagacctaaggatattggaaatctatctattaggctgtcgcaggctctattgtttatagtttctcttcaaggcagcacatatgcagtagatgcttctaaaaggtctagtatctaattgtatttggaggaggaaaaaacaacacaaacaaaatagacaatgcacttagagaaagctctgctctcccaccataagcctgacaaagatactccagtccttcaggagtttttattctaaatgtgtgcacttttgcaattctgatgccaccagtatctcattaaacaagaatcttcatctgaccagtgtgtcttttatttacaacacacaaaaaagcgaaacgtggtaagtgaaagaagcttcacaaagctgggtatgatcatttttgccccttcttgatatgattttcttttcttcttaattcttcagagaaggaagtattaacatcgtatattaaatgcagcatctagctttgtgttcacgtttttctaatttaacacattgcaattttagtccttcaaaactataaaaaaaatcttggattaacctcaaaggaaaaatgtatgtaggcaaatgaagtccatctaaagagagtatttctccaatatggtatcacttcagtgtcaaataatttcaccactcacaacactagtccagtgctaagaaatgagacccagaactagtgtccagatacatttgcacatacagatatacaaacacatacacatgcttacatatgtacacatatacatgtgtgcatgcatgcaaatacatacatgcgcaaatacatatatacatacacacacatatatacagatacgcacatgcatatacacaaatacatatataagtgtatgcatatatgcaaatagatacctacagaaatacatgcagatatacaatacataatgtatatacaaaaatatcatacatatgtatacatattactaaatacatactaagataataaggagagatgaaaatctttatccttattatctttattaatagaacgctttagaggactttcagatattctttatctttaatcatatccactagggcaaatgttgcctaaaagatacagagaacctggcttcttcccatttcacctctgctccttcctctctcatcctagaaggtgcttttccctatgctcagcacatcccttcagaacagacttagctggggatccatcccctccatgtccttcagccaattttcccggctctggactcacagactttctcagggctctgagaaggcctggctggtgccagcaattctctttgcccacatacttctcccctggccttgcctttattcaaatataagcattttcagggctggctcctctgtatgtctgcctctagaaataagataatttcttaacctcaaatgcttgttggtgttcatattagccctaggactaagacatcaggtgatattacagccccatcataatgctataaatgggatccacaaacttctattacatccaaatgaagagacgtgtttttgtgagatgaatggattgtgtagccaacgcccaggagttccagggagtttggaaaataattgccattggcaatatgtctgcagtcatactaccaaagagcgtattattgcagagtttcaccttcaatccacataggcttaaatagggacttcctatagctaagcaacctatgaacaaaataagacttactggaaaatgaacgtttgcaaaagaaggagggagcattcaatctggaaagcagaaactctagaaatattgtgaaagattggagcatggtagaaaaatgttaaagaaagaatagttatgtccacataatgaaaattagatttaaatgagccttgggagatcaagaatgtcaaccaacatcattttaaaacaactctgttttctcagtgccatgcagaataaacctcgaatgcatttgaaaggacaatgaactgggactctttgccctggcaaatgccatttaactgtttaagaaacaacatgcctgtgatgtgaatagcttcttattttcttctttaaagaatcgcttttttggctgggtgcagtggctcactccagtaatcccagcattttggcaggccgaggcaggtggatcacctgaggtcaggagttggagagcaggctggccaacatgatgaaaccctgtctctactaaaaatacaaaaagttagctgggtgtggtggtgtgcacctgcaatctcagctactcaggaggctgagacaagagaatcgcttgaacccgggagggggaggctgcagtgagctgagatcgcgccacggcactctagcctgggcaacaagagaaaaactccatcaaaaaaaaaaaaaaaagaagaagaagaatcactttttcttcccagtaggcttctttccttctttggagatgagcaaaaagtataaaaacatctgtggaaacctcctgtttgtatgttttacattggaatgggtgcaaaaaatacactcactattcctttacatccttctaagagggctgtttctactcttgacactcaatacttgtttttgtttctctaatcactgttatacgttactcacgaatattcatcaaaacccttttccttattttttatctagttttaaataattcatttgagataaaaagaagtttttctttgctttttttaatcactcagtggaggatgaacatgaagctgtaccaatggataggagaccgtctggtagagcacgggagccagggatagggatctgaagatggaagatgtgagtttcaagctgggctctgcccttgctctgggaatcacctgggtaaatcctttaaccctttcctgccccaagtgtgagctgagagcttgccagaaatgcagattccgagtctccagccctgctgagtcagaatctgctttgtaacaacttccccaggtgagctgggtgcctgctcacttcaacaagtgctgcattatccttttttgactctcaatttcttcaactataaaggtggtactgatggcaaccagctgccgagcagctctctcccaggacagttaaatgggccaaataatctagtgtgtgtaacaggtttcataaatcttaatattgtatttaaattatcatatgatagaagggtgatgtgactgactccaaacctctgcatgtgaaccatcagaattatccattctagtcatattattctaacaagccagatgcaaggaaaatcacagtctcttgtgtgcaaattatcacttattttttgtaagtactggattttcaaaccaagtatctacctaacagaggggaagggagatctagcatcttttacttcaagagcacgtctgtcactttgatttatagcctttttggtccctggtccagttcttttgtgggttttccattcaaattctacattagtttgtttaatgtcaattaaatcaaagctttgtgcaggaaggaatgaatcctggtacactccccagcgtgctgttggtattctctacataacaagataataaattaatagatataccatggtcttataacataatgttctttttctttctttctttctttctttctttttttttttttttacctagaatagcacaaggcacaaagttgatagccctcaaacttctgaagaaaagtcttttcttccaggatgtggaatccataatgctttctatgttaactttccctaaaaattgttgaatttttcataaacttctatgaggaagtgtttccatggcagtctggctaagaggttcacaccatcattctgtcctggtgatttttgaaacttacaagcccaggttgaaactcaggtgattcaaggcttgagaaacacaaaggccaagctcaaggagtagcaaagttgcttgcactttttttctattggcatggtccttctctgaacaccagggaaggggtggtgcaccacctctctcctcttcagaaggagctccgtgaaaaatcggcagttttatgcttggccctttcaaaacacacaaaggctaaaaatacagtgtgctacgcatctggaatgtgtctcatctgtgaatctctgacacatggattcattgttttcgataaaattccaggaattttattcatgagaaaattctggcacaatggaaaaccctggcaagcaaaagataggggcagcagatgtcctggcctccacccacaactctgtctctgcttttagctaattttcatcaggtgtcactctcatgccttcaaacactcaattcaaaatttcccataagacgggggtgagggggtgggggtgtcaaaacagccttaattttttaaataattggtacggtcccccccctccccacagacaggtgtgtcacaccaggttcaacatgcacgtgccaggatgcaggatgggcactttaagaagaagccgcaagaccacagggccactggccatggggctccaccactccgtgcccctcatgtaccaagtcttcaagctcctcgtctaaaatgagggtctggtctactgatgttttctaagactccattttgcaccaaaatgagatcgatttgtttaactagtaacatcctctttcagccatagccaggctgcagtctctacctcctccatctctgagcagacatgcagataaggtagaaatctaccatgtatggagttgctaaaaagttcctatgcatccaggttagatgctaactgcagggtctttccctgctgcccccagactttaattttcctcaatcttgtaggtatctccttctgtgctaatggtaagaagctagtcagcaccctgagagctagtgttatgtttttaagtgtggaaaggatctactctcttgcatgggaatatggcatctgttctacacataaagcacttcaataataataataaataaaaaaatttaaaaaataaaaaacacatggcaacatggtaataccaacagaaagtcttgtagaaactggggttctggcagacagaggagcacatgaataagtctccactattcacatgatggtccaggggtctccttcttttgctttctatccccatccccatcattgttggcatgggccacacactgtataacgcagacatgaacacagacgttttctttttcttagacgctgacttacgtagaaagagttagtcttcacccactgtgagggtccaatccctgccaaggtctttcttcagcttggtaagtgatgatgtctgactccctggggctgggatgctaagcctgtgcttttcagaagatttttccagcacataaatatatcctggttgctgcatggaaaggggactaagtagccaggtcatcagagccctttgctaatgttatacgctgagctcatgcttttcctatgacatagatgagcactgggtagaccccgtcctggtaacacttttcatgcactaacaagttggttgccagtgagacttgatttttatgactctgggagtgctgacctcaaaacctaatacatttgaactaggagagcaatccctccaacaatttcaaactacacatacttacatcacatccaatagggctcttttgccatctggcttgagcccctctataaatatgtctactttgaaagtcacaagcctgggcggggtggctcacacctgtaatcccagcactttgggaggtggaggcaggcagaccacgaggtcaggagatggaaaacatcctggctaacatggtgaaaccccatctctactaaaaatacaaaaaattagctgggcgtggtggcacatgcctgtagtcccagctactcaggaggctgaggcaggagaatcgcttgaacctgggggacagaggttgcagtgagccgagatcatgccactgcactctggcctgggcgaaagagcaagactctgtctcaaaaaaaaaaaaaaaagtcacaaatactctttgaaagtgtgcagagtcattcatatccaaaccatcaaggcctgcccaacagcctggtgacttgaaatcttgacgtgtacacagagtctaaacctcggtctttagattgcctccttactggacctctttacttattaagattcatccttgtggaggaagtgaggtcatggatgttcacatctatctttcccaggaagaaaaggaagcttcaagagctgggaaatgctatgcaccactgtgcaggttctgagcagcacagagccacctgtggggtgggcgggtaggtgagtagtggacatctgaccaccaggcgctgtgcaggactacctccttgcagagcaggtggggccttccaagttgcctactcatccaacctgcacagtaagccttatgggagcgtcatggggctacgcctacttcaaagagcaacttagctaaagggaaagagaatttgcacttgctctcttccactctagcagacttgcacttgtcgctatttatttgtgaacacagactcattttagattgacttaaaaataaaaaaaagtgcaaagaacagggcagctggaagttgggaaaccacttctgccactgctgaatctgaagccttaagctcctgaactggaaaaccagccgactggagcactgagctccctgggccctgtaaaagagcacactggccaggcatggtggctcgtgcctgtaatcccagcacttttggaggccaagacgggcagatcacgaggtcaggagttcgagaccagcctggccaacatggtgaaactctgtctctactaaaaatacaaatattagccaggtgtggtggcgtgtgcctgtaatcccagctactcggtaggccgaggctggagaatagcttgaacctgggaggtggaggttgcagtgagctgaggttgcgccactgcactccagcctgggtgacagagtgagactctggctcaaaaaaaaaaaaaaaaaaaagaatgcaccaagtagtggccagtcaggctcccatgggccttgacacgtgagatgtcaggcagaatttttattaatgaatctgatgccaattcagtatttctgcaatcacaatgcactttcgcaatatttatccaagcaatatttatccaacaaaaatatccaatatttatttatccaggatctcgcaaacgttcagtctagtttcactcacgtcagtgtctctaaccttcatactttgctttcaagcaagagtcgtgtgttggtctgggtgtccgaaggtgggggtggtagctggtgatgcaaggaaccaaaaattggccatacttacttacttaaatatttcacagctctttaacagattctcatctcctgctctcttctcttctccaaccttgccgtctggttctgacactgtcctgccacgattaggagtgagctttttggggttccctcaaacattcactcccagctggtctctttgttacctactcaagagcagttcatactgttggccactctccccttttttaaccctcttttctttggcttccatattcctgctattcctcctatttggttgacaattccatcccccatctctttatgccctcctttttctctcctcattctctaaatgtcagctttcctctgtgcactctcctgggccacttctctactaggctatcatttcttccaagccatcactcaggagccactccaatggcctcagcgctgccaggaagcgcagcgcatttaatttgaagggtgaaactgccttggagggatggcaggtgcatgcttaataacttgtttcccaaggccacataagtgtcattactggatgataattatcagctcaagagggaaagttctaagacagagaatgcaagatttctaaacaggtctaagacagttttccaatgtaagatttattatgtaacagttttgaaagtagtgtctgattccctgtctatatcctccagaacaatctgagggcatggttgccattacaatttactttgggggacgattttatagcacgtcttcacagacaacacgacaaacatctttgcttctgctacactgacaacctgaagttaacatttctgtacctatgtagccattttaatcaccccctaaactggttattccacagcccaggggtgtgggactgagtcagatgggctagagatacctttattcagaggatttagaagtttgcctcagagaaaggccatttctagtctccactagaaatcacacatatcttccaggaataagaatattctcttagtcataagttcaacaaatatgtactgaacaccttttctacttagaaacttgtctagctgcttctagattacatccatgacccaaaaccacaaagacacctatctgcataaggcttgtattctagcactacaagccacagataatttttgaaaatcaattaatcaaccaataattgatagggtaaatttataaccttgtttttcaagcctgatctcagggttagaaggtggtaagtgataagtatgaagaaacagaaggcagaactagagactcaggaaaagagaggtaaactgctgcttttcatttagagtggccagggtggtcctgagaaaacgcgaaggaggggagggtgtgagcccccatgcattcatgaagaataggccttccagccttggcaacagctagaacaaggccagagtggactgcgggggctgcacgaggaacaatgggaccaagaacagccagggaggaggggttactggaaaggagcgaaagaaagaaccaggaggtgaaccaggaaaggctgggggtggtagagccttgcaggccatggcaggaacctgggtgttgactcagagagaagtggagtctctctagccgtcttggctaaaagcccgggaattgtcttcttctgtgttgcactaatattttccatctcataagggttctgcaaagaaaattctttctatctttaaagttttattattttcaaaactaaatgtgatgagaatgcatatattgcatatgccatgtgtacaccaaaagccacacctaataaaatgttacagccatcctttgtcccacatgcaacgggaacttccattcatcatcacatgcagaaactctgggaactgagaatctgtacttttcattcagagtctgcaaggggtcacggccattttgaaaggctttgactcacacaggaaatacctcactgaggctcccacccacccatccactaatagggcagcctttagggaaactgacttgtggcaactgaaaggaataacggcaccaaagtattcccctgccctgaaatctctgtttacctgtggaccggtgatgggtgtgaggctgtaggttttaacgagctctgaatggcaaatggcagacaatggtgtcacttcctttctgcttaggaaggagacgtttggaaaaactgttcactgctgtgcttgcctatggagaacctggattcccagagctctatctggtagaacgtgtctccatattaataagcagtgaatcctcttttgcggctgaattttcctcaaggaagcagcatgggccttattactgccttaaaacccaatttcaatattcgatacatagtctgtgtattcatttgctagggttgccaagacaatgtaccacggactgaggggcttaagcaacagacatttattctctcatggctctggaagctggaagtcagagagcaaagtagcagcggggttgattcctcctgaggactccctccttagcttgtggatggtcatcttctccctgtctcttcatatcatcctccctctatgcatgcctgtttctgagtccaaattacctctttttataaggacatcagtcccactgaattaaggaccaccctaagggcctcattttaattggattacctctgtaaaggccctacctccaaataaggtcccactctgaggtcctgggggttaggacttcaacataactcagggaacactattcaacccataccatcctccaggaaggcagagaatgtgtccctcttcttcactgctgtatctccctgcctagcacagtgccaggtaccacactatgctctgtaggtcagtgattctccggagctctgtaggtcagtcattctcaaagtgttgtccaggaaccccctggggtccccagacccctctaagggcaggcataagcagatctgagaatccagctgcctccaattagcccagacattaaagagattgcaaaaaatgcaaaacaatgccacttctcattaacattttcttggaaaatagagttacttttcataaaaatatctcatttgtgttaacatgcaatgagtttatttatttatttttattttttgagatgaagtttcactcttgtcacccaggctggaatgcaatggtgtgatctcggctcactgcaacctccgcctcctgggttcaagtgattctcctgcctcagcctcctgaatagctgggattacaggcgtgtcccaccatgcctggctaatttttttttctttttctttttcttttttgagacggagtctcgccctgttgcccaggctggaatgcagtggcgcgatcttggctcactgcaaactctgcctcctgggttcatgccttctcctgcctcagcctcctgagtagctgggactacaggtacccgccaccacgcctggctaatttttttgtatttttagtagaaacagggtttcatgatattggctaggctggtcttgaactcctgacctcaggtgatctgcctgctttggcctcccaaagtgctgggattacagtcatgagccactgcacctggccttgttattgttatttttaaatgaatttataagtaaatgtttcaaaatttctgtttttgtttctaccaatagatataatgcatatacacaatttttttttaagaatcctcaaccaatcttaagaacgtaaaggggtcctgagaccaaaagattaagaatcactgccgtcgaggttttaagcttggctaggacacagtctgtacttactgaagtaacccacagtatgacagtaataagacactttatgaagaacatattttcagtagctaagtgtcatagaaaaggaagcttgttagccatttcctcaagttgacaacagagagtccttaggaaaataattttttaaagccaatattgagccttccaagactgcacatggtgatatgttaaatttggaatttatgcaacttaaaaaactgagagtcgggggttggcatttttgtgcatcctaactgacgagtgctgccccagggctctctaacactgcacacagtctactaaagaagcaggctgcccatcatgacccccacccatcagctacacagcacacatctgcttctagatgaaccttcttgcaagtggcctgtcttatggcaaaatcaaggggcaggcctgtaaagcggaccaggaaatgagcagcaactgcataccaccaacctgttgccaagctaactgtgcttttctggatcagaggcagcttgagacactggtccctggggctgagggactgcagagcccgggcacagactccctgcctatctcccagtgtgtccatcttggtacacctggtgcatctctggattggcaagtggcactccccaattaatgttaagggccacttgttttaaatataaccagattattttaatttttaaatgtgtatcccatacttggacactgaaaggtcctccctgtttacctgcttgctggggtctgtgcttgggtgtctcattttattataaaacagagtctcaaaggcatttaatactaagatcaagtggctgggcatccatcatgtgcagagcaggagcctgatggtggtgaaggctcattctgcatgtggttgactctaggaactactttaacagaggggaagaaatacactgggagaaaggagcaggagattcgtcagggctgggggaatactggctccatgagggcagagacttttttctattttttctctttttcagagcctgtaagtgtccacatatcatgcacatgcagtgcgtatttgttgcatgagctcctggtatgcaggtgccaaatgtcatgctaagtgtgtcgactggatgacagaagaaggaaggagggattaaaggaactggtgtgcactggcctgagccttgaagaatggggtgtactgggtaaatcaaaatggtggggagcatttccagatggagaaactgcaaggaaaagcatagaagtggggccacccctcgtgagctggggagggcccagggtatgtgtgctggttggggggaagctgaaactgaggaaattcccattggatccatagcctggttctggtttccacaggcctgggatgccccgtccagagtttgactttcagtctgcacgtaatccaggctttgtattcccacttcccgtatcccctcactcctttttcacacaccctttttatctatgatgctactggggtcatgggttaagaagtcctgtcgtctaagcagcaagggtgcatcaaagcaggattttctccattgattccaaggtgtgattcagaaatggtaaaaactccgaacactaggatgagcactggggatgggttcatgttttttttttatgaaataattcagaacttattaagaattcccttggcaaaccaaattaaatattaaacaactatttgttaatatgttactattggattctatcttagaaaagtgtaattatgtgtaactgaactttttgttttcttgtggttgaaccctgaattaccatgccttctggtttccgtgtttttcctggggaataggtcatatttcttacttccaaagcccagaaataaaagcctcacacatccatccgtagtcccaaaggcttttctgcctagtacccagagagtaacagcagtgcttcaaactatttgtggacaagaagtcctaaaacatcagacacactgtggaaagcaatttcatttcattaatacaattcataattaactgcatttattttattgtctaaattccaactgctaacctatcatatcgacgaattctttgaagttgcctttattctacaggatatgttcatttttagataatgctatttttcatatactttaagttctggggtacatgtgcagaacatgcaggtttgttacatagttatatacgtgccatggtagtttgctgcacccatcaacccatcatctacattaggtatttctcctaatgctatccctcacctaccctcctaccccccgagaggccctggtgtgtgatgttcccctccttgtgtccatgtattctcttgatcatctcccacttattagtgagaacatgtggtgtttggttttctgttcctgtgttagtttgctgagaatgatggtttccagcatcatccatgtccctgcaaaggacatgaactcatccttttttatggctgcatggtattccatggtgtatatgtgccacattttctttatccagtctattgttgatgagcatttgagttggttctgggttcatgttttaaaatctcaatttgctccctagtcctaggaatgatcttctccacctccaaggaatgcaagccccagtgcaacatggattcttcctctgtaagaggctagactccaaataatttgtcctgtttttgcctgtgggatgttacaagtgtaccctgctgtctgtaattgtgtttctgaagtgttctatgtaagtaggtttttgttagttgaattgtactttaaatgtgccaatcaagttccccatgaaaagagatgggcacagagactttttgaaaaattaagcatcccaagagaaaagccgatctgaaaagactacatattatatgattccaattatatgacattctggaaaaggcaagactacagagatactgaaagatcagtgtttgccaaagattagagggagggaggggtgaacaggtggagcactgagggtttttagggcagtgaaactattccgtataatcctataatgttggatacatgtaaatatacatttgtccaaacccacagaatgtccagcaccacaaatgaacgctaatgtaaactacaggcactgggtgataatgacctgtcaatataggttcatcaactgtagcaaatgcactccgatggggaatgttgataatgtgggcaaggctacgcaagtgtaggggcagcaggtgtatggaaatcactctatcttcctctcgggtttgctgcgtactaaaattgctctgagaaataaagtctattttttaaaaaatgaagtattccaattaatttataagttttgccacacgtgcaatgacggccctaaccactttactttggttctccgatactgaatatgtcactgtgaatatctcatcctccttgatcccatccccatcaaaactagagattgaaataaggagatgagatggccctccctgaccgccttgtgcctttcagaggaggtgcctgggctggaatggggaggagctaaggactcctgtgggattctgatgctgggtgtgaaactgtctgcagttagcacggtgttggagagatgagtgctagactttgtatttctggggactagtgataaatgctcattattatttatataattttaaagctacgtttaaatttgtccccagtactagagactttaatgttatattgaaataatacataataggctgcaaatagttatattcttgtcttgttgttgtccatgtatcagcattcttgtatgaatgaaactagaaccaagaagaaaatccatcactacaataatggtccatacattaaaacagtttaggctgtctgatggtctggggtgtgtgtgtgtgtgtgtgtgtgtgtgtgtgtgatatagatatgtatgatatatatgatgtatatatgatttatatatatataaatcatctcatcttgctcaaaacaatatcactcttatttaggtaggcacactggaatatgattttaattaattgaaaagtacagtttgtttcacatttgcaggagtggtttaattcctacacagtgtactaagatggcctctcgtgggctcatgatcctggaagatatactcccaaagtgagggggggtctatgttggaagcaaaaataaaaggaatttaaagaatgacaggtctgggaaattattcttatggatggtcagttcttcatatgataaaatagttatgacaaaccaaacaggcacagtctcatgtatgcactgatttgcatgaaccaactttacagataattgattcagttggttggaactacagtttcttccaaatgtggacaacttacaacagggtgggagccccaaactgtgaagtcatgtgaggtcatatacaaactgaaaaacagggtttctctactggaatgataatcctaccatgttacacttttccccaaaatgaaatccaacatctttcacctggcgtaagaagcccaacatgttctggcccctagaaacccttacatcctgcaaagagggactagagcttgttactcttattagctactcttaaagtcacagaggtagttaatttggcaaggagtggctacaaattcaagacatgtttggatgtgctgagaatcagaatccaatctcggccctcaagtcatgggttaaagacttggttttttatctatatgaggtcctaccttgtagttcaagcagaaacatccaacaaatgaaagcagaaacaacatttgacagctcaaattcaaaagcaagaggcttgtcaatgcaaaagtcttgtgctgcaaatgtttcaagggaagtatccatactctgaagtgtgcaattgaaagaatgacctgatattcttgcactgttgcctcaaacaaacctccctcctcctagctagctccggatcttttatgcatcatatagtacatcttcccaaaaaagcaggtggaaaccaaagtgtgcaaaaacacacattttccaagaacaaatgcattatactagcaagttatgtgtggtggggctaggtgcttctgcgggtgtggaggaggaggagagaaagaagggtcaggaggaagtgtgttgggtacagagacatggaaataagaaacaggaaccctgaaagacacacccgcggaggttctgtaactgtacatgtgctcttgttaaatcgccagtttcagaggactcagatctgaggccatatagaaatctattaatttgcatcttgactttggggcttccagtaacagtaagtatttgtatttcaggatccactcagcagaaaggccatacatattcaagtcacataataaattggtgaattccaagtgaattgtgaataccaaaaaagaaaactgattatgtgactttctggaatatgatgtagaaattgacctaacaaaatgtatatgcacacttacggcatgtgtgcatgagggtgtcatttatgtacacaggtcatgtgcacatccaactcatggccatgcatgctgtagcctgttacccattctgggagatatgtaagcctttgtctttctccctccagcttcctgccttcttaaaacatttcactggtcatcaaccaatgattgaagctgggtgcagaaaaggagaaaaggtgaaaactcctcttagtccacaaggtgacgtgttagtgcttcaagtgaaagggctgtggtggagagccagagaaagcccttaggtggaatgagactgtggttcctataggtcggcaccttcctccccacccggcaggtcagctcatcaattgcacttatctcccagctgccacagcctgtctcactcctttctctctcctgttgggctgctaccaggcctggtaaactattccgtagctctgtgcaatagaaaatagatatgtatttctctgaatatagagagggaaattggagttcacatggaatgcatactgtaaacttatttgttttctgaaagcaaaaattaaacttgaaaggagcaaagcttttcaaatttcccatagtgctggcctcaaatcctaaagatttttttccttgacaagaatcatgggatgaattggaagatctggatgctccattcaccacagttgatgatgctaaaacccatgtgacagcagaggaaagaattgaacattctaaagtcccctctggcaactggaatgccaggggagccttcaccatatacctcatcaagccaccccaacaaacctgccatgtcggtgaaaagaccatgctcactatgaaaatgtggcttctgccgggtgcggtggctcacgcctgtaatcccagcactttgggaggccgaggcaggcggatcacgaggtcaggagatcgagactatcttggctaacacggtgaaaccctgtctccactaaaaatacaaaaaattagccgggcgtggtggtgggcgcctgtagtcccagctactagggaggctgaggtaggagaatagcgtgaacccgggaggcggagcttgcagtgaaccaagatcgcgccactgcactccagcctgggagacagccagactctgtctcaaaaaaaaaaaaaaaaaaagaaaaaaaaaaaagaaaatgtggcttcaagaccagaactctagccctttgtccaaaaaaaaaccatagcccccgagacccctgatggccttgacatgccactgggggtccccttatctatttacattatagaagggcttctaagaagaatggtttcagtcagagaatccaagcaacttatgctaaagtccagcctcatcctcagaactctgggcatgcttgtttttaatgccatgtctatccatctgtgactcattaacgcacttagcaaacactgagtgactgactagtctatctctccccgtgataaaatttaaacgcctcttacaagacatgagtagtctacctacctgttacttgtatgccattacctgaaaaattcccatctgtttggatgcaaacttcacagaaactctgccacaaatgctcacgaacaccatcacatgggctgggctctagtgctttggaatatcctactttcttagaaaaatcgatgagtacatataaatataattagctgcaccttgattcctgcggaatcattgtattaactgctttgggctattctccttctttcctttcaggcaatattaatttgtaacaaacacattttatgatataataaattatctttcattttttactatcaaatacatggagaagtaaaaaaacaaaaaacccagaacttctaggcagctcttaaacaagtcttgctgttacttggaaaagtaacaaattcacaggtttattgtctatgttaataaagctgtgttggagtagtcattataaccttttacattccctcctgtttacagctcacagaatatgtttacacatgtgatctcattcagttgtaacatgatctgcataaattatgggtattaacacttgccatatttattacaacgatttccccagcaatttgtcttcttaattgtataatctatattgcaaacagatgtctgcagtttgtatatgcagctatgtactcctatggtttatgcatctacctcaggccattaaactgtaagctcctggagggcagggatgtatctgattcatttctgtatctccggaacccactgcacagctgctgaatggatacacatctagttacttaacctctgtgtccttcagtttcctcatctgtgaaatggctataatgattgcaggaacctgtcttctctgtcccaattgtattaagcaaaacacttaatacaatgtctagcatataataagcactctatgagtgttttctattattattattattattattattgttataattatctggagttaattgaattaaagttcaaaaagatgacctaactcatttgggggaaggtgatgaataaacggcagaaagaaaggaatatcagggatcttatatgctgatcctagctttgtctaatctgccaagctaagtcgtaagatttttctcttttcaaaatacttctgttaagctagtaaaaattatttacttgtaaagattccatgtgctgctttttctgtcataattgcatttaccttaccaaatacatattgaccatctacacagtggatagcagaggggccacagaaatgagtaaagtctagttcactctgcactggtatctcttttcttccatatttacattttataattacatttgtcaaactgcttcacaggcgaagtcctggaccaggaaccaaataaaattgacccagctttccgaccatggaaaactaaaagtataatcaactttggcaccattaaattctgtttcatttattttttccaagagtctattaacattgtcatacagaagtagaagatttaattgagtgtgtgcattttgagttgaaagcagatactaacaagaaaagctaacctggaagacatcttgtaaactgtttcatcagactggaccaggagccaggggagggtcgaggtgactcagggctgttggcaaagctgcagaaattgccactgggtttctctgtcctctaggcaacctaggctgcattggctctctggcctattattcattacggtttagttcaccacagaggttgccagtgagcagtgcataagattagagattttgtaaaaacatgttaatttgtatgaagacgaaaattggactatggagtttagtgataaaaatagataaacagttctgtcatttgatttaaatattaaaataagacaagacaaagcttttaaggaaatgaccacttcttggttctcaactagaggcaatgcctcttctgtcctgagcagatgggtgtttgggaatacgtggggtgacttgggttgctgtgataatgcaggggttctctggcaatcagagggagagggaggggcaccttcaaactgtggtccagatctacacaatcaggaaaggctgttcacctaaaattcaaccttctgttgagaagagcaacacttacggagctcatcaaagaacgacaaaccactggaacagttcttgagaccaaagtctcattcactctgggacatatccagttacataaatcatttatgttttatcccgtctctactttcccaagaaaccctgccacacattcatagtgaatatcaaacctaattaaagatcctaagcagctgagaaaattactcaatgaccaaactataattagtcttctacaagggagaaaatgtattcaaatcattgcttaattttgtttcatttcctcttacctgcacttgaccattaagatcaaaagtctgagaatttgtggccaaaaaaaatgaacatgagtcaaagtcacatctatttgttaataatggaaagtaattccttttctaattacacgtgaaaatactagtatccaacaaacctatttgtggaaaatacggtttagattgggaaggttaattactttcaggtttttcaatgtccaaaacacacctcagaactaacaggctcagacaagatctttatgagatcactggatcctccctccaaaagcttccccctcccctgttgatctctattccatatgctgcttcatttgatcgtatagcgtgtatgatgagcctgaatgcgggcatttgttgatttgagtattacctgaaacaaaagatacaccagaatgtaaaacccaggagggcagagactgttttcccagaacctagaacaactcctggcacataccagatgtaaaatcattgtagaaagaaagaaagaaagaatgaaagaaaggaaggaaggaaggaaggcatgaaacggtgcactattattgtatgccaccttaagtcactcatagaaaatactgcatgccagcactctatgcaatgggtgttacactagccattatgtaaagtcaatgacgggattatacgctgggcactttataatttaataaacacccttcaattaccgtctcatttgctcctccatgccactccacatagtatacgggacatattttaggatcaccagtttagagataaagacagaggttgtgtccccaaagtttgcttgcgagtgtggtatttgtaacttctaaaactctaactctcccctgaaaacacgtcctaagagtggtgaggctcccacgtgaggtggcaatattggttacccccgctgagctcatcacattgcgcaggcctccacagggcagctacactctacgataaggaacatgaagccctgagagtcaggagggagaaaaaagaaaatgaacgtttggaaaagggcattcccaaatcacaggagaaggggaagaaacgtgtctcagctactaagtttctcttttccatgacgctcaaagcagaaaatggctgcacgtgggcaattcgtgcgcttggagctcagacctgcagtcttgtcgtttgtctgccctgtcttggtgcatgctgggcctgacttttttatttttccatttcaaggagccccagcagggcctggaggaaatgagttttgcagcccatctcggcccttgagcttggctcctcggctgacctcggctccccgcctgcagacccggcatgaggcaggcagcaggcactgcggggcagaacttccgggacctgcaagaccagtccgctgccttctgagacgtagttctgaggtgtagcaagttttcattttcacagcataaaaccgtctacaaatacatacttcaaaatgaaatggaggatgcgctcaaaaaaaaaaaaaaaaaaaaggcttagagacacgtcaaaagggcacaggagctcagccaggtcaaataaattcccaaatttgactcacatcacttcagcctcatctggatattacccacactctgcctaggcaggcgaagcttccgtgggatcctctgtctttagtgaattctttcctttatcttgtccagcttttcattgctctttcagaaactgagcccatggttttaaatcttaatatgaccttgcattcaattatatatatacatatatatatatatacaaagctgttttttaaagacaattttaaataagaaaaaaataattattttagataccagagagtggtgaaataataatgattcaaacttaatcctcacttcacgtaggggaaattgactcaaatctgggagcatcaaaaattaagatgcatttacaaatcctaggagaagatatcctttgtaatctcagagaaaataattgagagagggaaaattttttttgaaagacgtggtttggacatattactattttgtgaaatgaagttaaatgtatggtacagatattaaagttcacttaagttttatctatataaagtgtgtgattttggatctaaacaggcataaatatatatatgtgtgtgtgtgtgtatgtgtacatgtttgcgtacgtatgcatgtgtatgtgtacatgtttgcgtatgtatgcatgtgtatgtgtgagcgtatgtgtgtgtaagtgttgtatatgtgtgtatgtgtgtgtatatgtatgtgtgtatataataggaagtaagttggaaaacatgagccaactgacttttttttccttagacagctaaagaagagtggttagaagtttactcacaagtaaatcttttaaggagcgtttacttcccagaaacagcaatgagatcttggaggggcaattcttgtcaactgtgcatcatcaatggagtttaactgtgagaggtaaaacccattgttggtcccgactccaccaacccaaatggtcatatctgaggacttcctgtggttctcccgcccccaccctctccacggcatttactgctcctgtataccctggacttctcgacaggaaatggcaaattcctcagtaggaaagccaagaagtgggaggtcacatggagactggaagttcattgcgtgcagcccctccaggtgacaggcgacaccgcctctgcatgttgagtgcctttgtgacacatgatctccttgtctcatgaccacaggcagcagggtcctgatgagtgccctggagagaactgtcctcccacccctgggtgacacagagtctcagaagccagcagaggtgctgcaccaaaggctcagactttcaccctgcctctcttctcctcaactctttgccctaaaaaacatgtgctttgagggtgtgttgaaaatctcactaagtcaaatgatgcctgtggggcagaaataacccttgctctgaaagggtcaccaaaaagtcatgagactcctacctgtatggaaggtggtgactatatagcccttgtataaacaaacaaatacggtgaaagacttggctccatttttttttttttgtctgttcgttattttttggagaaaacgttgtgataagaagcctttagcctacaaaaatgtctctagattaatgataatttatctcacttttctcagtgaaacagatgaatcaaagaaagtgaagcatcgtagacaatataggaccttcctgataacatctaacatttaataacgtgatcacagcgtggcggctctaaaagacatgcacatgtgaattaatgcatctaacctgcacactagctaccattatgcccattttaaagatgaggaaaactgagactccaaaaattaaataagttgcctagagcatcttgccagttaatgcaccagaattctaagccagctgcctggttccaaagcgcatgcccataaacgcggaacataatgcaccaaatggcctagaactgaaacgactgcaaaaataagtcaacatatgagaaactagagaatatataaagccagccccaccataatcagtggcaagggatgggagatgggaagaagggagaagggaagggaagctaaataatttcagtttttctctgtgcctttaattcctgtcccctgaagatgacacgctcattttagtagcaacccatgaccaagatgcattccccaagcttttcgcacctgacagaaagggactcggtgtccaggactgtgcccgattacaatcaaagcagatggacccttccttagggtagggctgttcttctgacagcctcctctgtgaaactagattataagaggatgtgctgctctcagacaccctctgcctgtccccgccttggggtccttgcctttgccattcccctggtccgcatcactcctccgaggcatttgcaaaccttgttctcaccttttctttgggtctctgtctgacaggccttgcctgatcatgttctctaaactagaggtcccgccccccggccacctggctctatcatgttccctaccttccctcctaaggctcctgacttcctgccacactctgtcttcgttgagctgtgatctatttgtcagtctcccccatctgcatccccctgattgacagcactgagtgagcccagctgtcctgctgctcatgcccctcagcacccatgagcctagtgggtgcccagtaaatccttagtgagtaaatgaatgagtcaatttccacacaccaaatcccaaagggataaaaagacattgcctttctgccatttcttggaagaattttttgagacaaactaaagaaaggaagctacttgttattaaatttttaaaaatctgcctactattttcaggcaaatatgtcatgatgacatctatgaaatctctgaaattaaagagaagcctgacgtttcacaggaattaaatgaagttgctgcatcacaggtgctccctgccacagggctccgtgtggcagcagcaaacagaactcctcgctgcttaggtgtagtccttaggaatgaaaatctgaacgtagtacgttaaaaaaaaaaatcttcaaaagcaaacaaagccctaagtgtcgctgtgtattatcagggcagggtcctcctcagagagaggcgggctgcaatcgcccctacacctttcaccaagtgcctcgcttcaggggtcccattgtctccacgtttaggtttaggagcctggctcttcgtaacaccagcgaaacatgttctcctaaagatgttccctgagatacaacaccactccgcattgtttcaccacataccagcattaatatcccagagtaatccaccctcctcttaacggctgatgacggctccaatggccatgcaaaaatcagttgaaggaaagggaagtcttgtcggaaatgagattagtcttgtaacgagtgttcagccctgataacccatctgggcacagaactgcttaaactggagagcaattaaccttcacccgacaagctctgtccaaccgttataaacattaaagagacagaatccttcccccctccttgtagactaaacaaccagatttgaaattccacgtaaacggcctctttctgcagatgtgcaccaacaacaacgtttagggggaaaaggtgggcaatggctctgttcataactctggtaacttttggccttggtgtgagtgggctgaggttattagcgtaaaaattaactggaggtatttccaataaaatcaccaggtttaggggactggacatagttgctttcatgcagaaacccatgtgtcctataggaacacaacttgatgcttgagagattcttttttcttttctttctttcctttttttttttttttttttttttgagacagagtctcactctgtcgcccaggctggattgcactggtgcgctcatggctcactgcaaccttgacctccccaggctcaggtaatcctcctacctccacctcccaagtagctgggaccgcaggcgaaggccaccatgccccactaatttttctgttttttgtagagacaaggtttcaccatgttggctaggttggtctcgctcaagcgatccacccaccttggcctcccaaaatgttgggatgacaggcgtgagtcactgcgcctggacttcttttttcaacagtagaaatatttgcactgggctagactctcactcactcccaattcctctcttccgacatttgcatgagtgatgctgcttgtggtcacagaagggagattttttttttaatctccgagaagttattggttttcatggggagcaaacctgtgatcttgcctttatcagcatttgccgtaaccagtcgagttaaccaagttgggccatgtgaaataccgagtggttagagaatctaccaggaaacctactgttaaaaataactttcacaacactgaagagaaatagctgaggtcacttaatttatcactcaggcatgagctttctttagcatcagttcatgctgagccattggcttgtttatggacatgatactaacaataaataggtaaagggtaagggccctatgacatagagctggctacaaaccaatgtggggtacacaatatgcctagcatttaaacaagaaaaaaatgtaaagtacatgcagaaagtcatatgagggaaccaaacctctatgttactgacctgttaatgtgactgcaactcagatttttttaaatagaaagaaaaaaggaaaacatatatttagcatgtcctaaacaaatttatctccccaaggttttagtgcaatcttcatgatgacctgagatagctatcaaaatagtccatcctaacattcgatcttatctctcccttgaacccagtttctctttttccagtaggtaagtcataatactccaggcctcagagacgtgtttgcacacaacgaggctgagcctatctcacttataaggatgacatatctcactcatgctggactccagaccggccccaataacagttttggagagtggcatggtagaggatgtgtgttacatgggaagtactactgtaccctgggacaagatatcctggcaacaggtcttgttttcatggtttgcatttacatgcttaactgttccttttcctgcctttgtaagactaagaaaatccttactgtacagagaaggaactgtgaaaatagagcaagtgggactgactctcacattgcagggatatgcaccatctccatttttgcagccaaattagatgcaagcccaggattccactggcctggttctcccaggaacactgggagtttcttggtgtcttagcttgaggtgaggtgaagatgggctatgggcacgtgagctgaccagtttttcatcctgtgtgcattggacgtagacaagggcacacacagacatgacaagaatccatgacctagctcctaatgtaaatcttctttcccaagacaatcttgcagagccctcatggtcagtgataagaggaacttcaatttttatttggaatctgacccatttcataagaatgagtaacacctgaatatttaggtgcagatatcaaagacagaagacaaaaagaaatcatagtgtttgacaataatattagtataggatgccgttttatgagttcagtcttaggactgtgtaggtgcaacgtgaagactttcctgaagacagccacatgaatcatttttcataggatgtaatcaccactgtcatccattagtccaggcttgacacatagaatgggggtgactggctgcctaagtaacaaactccccacgtgtgcttctgacgaactgtgtgggctgccctaagcttttgcatgtctcgacacttaccaagtaaaatgatgagataaggaaaaccacaacatcatactcagtatcttgtgaaactgaaatggttgcagagtaaacactttgccttacagtgattttattttgactattatgctggatttaacaatataatggttaatatccatgctataaagttttattttttcatcaacaaaactaattgcattggcactttcaaaatgttgtttgcacataaatgatttatacttaagtatgagtgtaacaatcttgccatcaggacctggtctgttgggagatatcagtgaatggagcctggctcttccaatgggcaaccgttgtttgttggtgaagctgccacccttgagacctgcctggtctccttcccacctgtagctggctaagtagtgtctccccacaattcacgtccacctggaacctcagaatatgaccttatttagaagtaggatctttgcagatgtaattaatgattaaaatgagatcatagattagggtaggttctaaatccagtgagagcatcctcataagaggctgagcaggacacacagaaacataaagaagaaggtcgtgggatgacaaaagcagagacggaagggatgcatctacagcagtctccccttatccacgggggacacactacaagacccccaggggatgtctgaaacctcagacaggactgaacccaactgccattaactggaacactttctgttccatccacaaatgcaataccttttccatcttaactaagcacttactatccactgtggtcatcagttttgcagtttgaggtgcaacggcaaaacaagcacagatttctttttatttcttcaaacttcaaagacagaagattcattcttactgtacatcttagcaaccacagcatatgatctttttccttgtaagtacagaactttcaccttttcactgaaagaaagcactttacggcttctctttaacatacccggaattgccaggatcagtcctcttgtgccttggggctactactgaataaaagaagggctacctacacataagcactgtgataccgtgacagtcgatcccataaccaagagggctactcggtgactaacaggcaggtagcatctgtagcatggatacggtggacaaaaggggaattcatgtcctgggtggagcagggcaggatggtacaagacttcatcatgctacttagcatggtgaacaatttaagacgtatgattcatttatttctagaaatggccatctaatatcttcagacagcagatgaaactgccagaaaccatggaaagtggaatcgcggataagagaggactactgtccaagccaaggaacacagggcttgcaggcaacccccggagctggaggaggcaccagatgcatccttcctcacagcctccagaagggaccaacccagccaacacctcgattttggatttctggactcccaagctataacagaataaatttctcttgctttaagccactaggttgtaataatttgtcacagctatcctgagaaactggtaacagtacttgtggatgctgtttttaacaaaaattttgccactttagggcactatatggcctttttttttttttttttttttttgccttatagagttaggtcaatttccaaaagtgctggagtttatgccaagaattaagtgactccctggttgcagtggccaaatagcctgaaattttcaaagtaatactaattttgcaaaacttttcatgtaaactcctttgcctgaccatgccctaatttttgtgattaggaaaatctggctcttatcccactggaggaaaagtgtctagttcatattctaatggaaatcatcacttgggaggtgttttgacaaacatctctcagttttgtttaaaaattatgttagaaattaagaaaaataacgaatggaaaacaaaatctaatttttggtatattttcctgctaacatttgtgggcaaattagttaaattatgattgtttcatgcatacttactcctccaacagcatcctagctctcttaggagttccttttaattatcctaaaaacagttaagagtatactgagccaaaatataattaggttgagaaacaatgaactcctaaatgaccaatcaagttttttccaacattttaattctcaaataaaggtcatttccttttatttgactccttaaaaactagattatagttcttctaggagaggaaccaagtcagatttcttttaatcacatacattgccaaatgcatgctttactcagggaaagatttcaatatgcatcatttattcatgcattcattcattcaggaaacagagtagcactttacatgcggacgctgtggaaacaatggtgatatgaattcttaaatgattaaagaaacagtccactaaaaatcttatcaagataatagaatacttcagattttatgaaagattacattttcattggcctatatataatgttttaaccagtaaggctcactaagttaaataatatgctggataatcttaaatttacagaagggttttcagttttactatttggcttagataagctggtagttacttgctaaaattaatctttattataaagcagatcatcttgaaactgaatacaaaaacaaacgtagctattattgaaaatgttatgctatctcatatccattagagatgttatttatataataagtactgtgttgtaatttgcctgattccaatgaatacagaaaccctcagtgtgaatcaatatactagacaccagcagacatatttaaaagattgctacagtttcactgacatttcaaagaggtgactgtagtaacaaaagaagaaaaatgaatagtccctatcatagcacattaatacaacttgtcactagttcatgtccagaaagacttattatataatagattgtcaaagttgaatatttcaatgacccaatgcaaatcctggataaatgctggtaggtgttgctgctcaataaaaatgaaagtggtgtttggttttgctcatcaaggcaagtgtcatgtagcaaaatgcaggctatgggttgcctggaaactgtattcctgcttttaatttacaagtgaaacattcccatccatggcctggaagggaccatcatgtactcggcagcactcattagattctgggcagcccccggtcatctgaccttcccaaacatagggaaaggacgtggatagacattttcccaaaaagacataataatgaacaatgggtatacgacaaggtgcccaatatcactaatcatcaggaaaatgcaaatcaaagacacaatgaggtatcacctcacgcctgttcagatggctatggtcaaaaagacaagaaatagtaagtgttggcgagaatgtgagaaaagggaatccttgcagactgttggtgggaacatggaatgttgcagacactgtggaaaaaagtatggaggttcctaaagaaattaaaaatagacctaccatatgacccagcaatcccttttctgggtactttcccaaagaaatgtaatcactatctcgtaaagatacccgcagtgccatattcattgcagcattactcacaatagccaagatatgaaaggaaccaaagtgtccatcaatggatgaatacataaaataaattgtggtggatatatacaacggaatatcatttagccttttttttttttgagatggaatctcagtctgttgcccaggctggagtgcagtggcatgatctcgactgactgcaacctctgcctcccaggttcaagtgattctcctgtcttagcctcccacatagctaggattacaggcacccacgaccacaccccactaattattaaatttttagtagagacgggctttcaccatgttggccaggctggtctcgaactcctggcctcaagtgatccacctaccgtggcctcacaaagtgttgggattacaagcgtagccaccatgcccggcccatttagctttcaaaaagagattctgccaattgccacattatggatgaatctggaggacgttatgctaagtgaaataagccacacacagaaagacaaatactgcatgatctcacttatatgtaaaatctataacaaacaaacaaacaaagactcaatggggaaatggggagatgtaggtcaaagaatataaagtagcaaatatgcagggtgaacaagtctagagatctaacgtacaccataagggatatgcttaataataccgtgctgtgctgtacttgggatttttgctttaagagtagattttaggtgctcttgccccacaaaaaaagaatgtgtaaccatgtaagatgatggatatgttaatttgccttcactatcagaaccttatcaccatcttcatgtatatcaaaacatcatgttgtacaccttaaatatataaaataaaacttttaaaaaataaatcaaaaagtcatagttcaaaccactcttttggaaaagtatggatttgttaatataagtggtatataacaattgtatatgcatctggggaaaatggactccatctttcatgatataaaaagcaattctcggccaggcatggtggctcacgcctataatcccagcactttgggaggctgaggcaggtggatcacgaggtcaggagattgagaccatcctggctaacacggtgaaaccccgtctctactaaaaatacaaacaaacaaacaaacaaaaaatagccgggcatggtggcacacgtctgtagtcccagctactcgggaggctgaggcaggggaatctcttgaaccccgggagagggtggaggttgcagtgagccaagattgcaccacagcattccagcctgggcgacagagtgagactctgtctcaaaaaaataaaaaatttttaaaaaacagcaattctttgtgattttaatatagggtgccagccacatcactgattcatgcactcactcatgcatttgtcatgcaggaagttatttattcatttatgaaatggacatttactgatagcctgctttttaataggcaccatcagcatgactgaaaggttacatgacaacagccacagaacttaaggcatagaactttaacaacacacgttttgagttactggtcttgacgcctggctaattttttgtattttagtagagatggggtttcactgtgttgcccaggctggtcgtgaactcctgagctcagacaatccacccgcctcaacctcccaaagtgctgcaattacatgtgtgagccaccgcgcccggtcggggttctatagattcttaatcatgattaaccagcaatatgataattcaatagatccctgctcacctcccctaaagaatgtgccactctaagtagttggttcaaaatagcttgactttttaacctctagatccactccagagaacagtggtctctccccattgcacaaacacattcatttatttaacagcatcacccaaagcataagaatgggaggaaacaatgaacgtccttcatttctccaactttaaattatcaaaactactgattttctgggctcacaaaaatgcagttgagttcagctgttgaaagtttggttaacatgtcagttgagccaccaaatggaataacagttgtaactctcttatgttttctctactgtcctcaaaggaatagcatgagaacaaagcaattagcatacattcaggagttgcataatgatgttttggacaatgacagactgcagataggacgagggtaccataagattataatggagctgaaaaatctctatggcctagtgacatacagctgtagtaacactgtagcacaatgcatttctcacatgtttttggtggtgctggtgtacaaacctactgtgttgccagttgtataaagtatagcacatacaattctgtacagtacataatagttgataatgataatagttgactatgttattggtttacatatttactataccatacttttcatcattattttagagtgtactttttctatttccaaaaaaaaaaaaagttaattgtaaaacagcctcaggcaggtccttcaagaaggattccaaaataaggcactgttatcgtaggagatgacagctccacacagattattgtccctgcagaccttccagtggcacagggacaagatgtagagatgaaaaacagtgatattgatgatcctgaccctgtgtagacctacgctaatgtatgtgtttgtgtcttagtttttaataaaaagtttagaaagttaaaaaaaaaatagaacaaagcttattgagtaaggatataaagaatgaaaatatttctgtacaactgaaccacatatttgtgtttcaagctaagtgagtacaaaagagtcaaaaagtttaaaaaattaataagtaaaaaaagttatagtaatctaatatgaatttactattgaagaaatgttttaataaatttagtgtaaatatacagtctttttttttttttttttgagatggagtctcgctgtgtcaccagactagagtgctgtggcgcaatctcagctcactgcaacctccaactccctggttcaagggattctcctccctccgcctcccaagtagctgggattacaggcatgcgccaccatgcccggctaatttttgtatttttagtagagatggggtttcactatgttggccaggatggtctcgatctcctgacctcgtgatccgcccacctcggcctcccaaagtgctgggattacaggcatgagccaccgcgcctggccaatatacagtgtttataagtctacagtagtagatagtgatgtcctaggctttcacattcactaaccactcactgattcacccagatccacagccactttccatcctgcaagctccattcatggtaagtgccttatacaggtgtacaggtgtatcatttttttcccttcttaataataataattattattattttgagatggggtctcgctctgtagcccaggctggagtgcagaggcatgatctcagctcacagcaacctttgcctcccaggttcaagcaattctcctgcctcagcctcctgagtagctgggactacaggtgcgtgccaccatgcctggctaattttttatatttttagtagagacgggatttcactgtgttagccaggatggtctccatctcctgacctcgtgatctgcccgcctcagcctcccaaagtgctgggattacaggtgtgagccaccgcacctggcctctactgcattattactatacctttcccacattttgatacataaaaaccattgtgttaagtgtcacaattgcctacagtattcagcctggtcacatgctgcacaggtttgtagcctaggagcacaggctacacttatagcctgtagcctacgtgtgcagccggctatgccatgtacatttgtgtaagtgctctttgtgatgtttgcacgatgaaatcatctaacaactcatttctcagaactgaccgggcatggtgatgcatgactgtgtagggaaatactttcacccctttagaagaagctataaataaccaggtataaatgcaggattcctttccaaagacaaatactggaaacaaacacaatcaaggaagataattgattacttcaaaaaaacaattgagatatgagagtaaattaaataagaagactgtgactaggataagtaaccaataacagcccataacagctaacattattattattgttgttattattatgagatgaggtattttgccaggttgcccaggctgacctcagatactgaggctcaagagatcctttgctttggcttcccgagaagctgaaactacaggcagctgccagcatgcctggtctgcaatttacatcttttgtacactacagcacgttactgttcaaagcacatacaagtattaagctgcttaatccttgcaacactaccaagaagtaggagttattatcatgactgactctcttctacagatgaggaaacgaggcacagggaagtgaaaggcgtggtgggacagggacctgcggtctggatctgcttcatatagagaaactgggttcttaagaaggaaaatgggccttaatttctaaatcgtaacaagttcagccctcactcctcttttttttttttttttcactatcctggaaaaaaaaaagaagtggatagaaaggtactaataacaatgagtttaatttctcaaattttattattctttaaaaaggatacattggtacaggagtaaagacaaaaaaaatcaaaaaagaatcgagtattcaaagacccttgatggtgtaacatcaattattttaattttgtttttaaaatttttattttctaaactcctataataattgtttttcaaatggggaaaaagaacgaagtttttattactgcctttctttctacaatatattattcaatggagatactgaacctgtatttgctacaggctaaagaaaataaaataaaacaatccctagccaggcaagggagattttcagagaggatgccaacagggtcctatcccatcaggcatccatgacaaatctgtctgctgtctggtcctgtagcatcacccaaatgtggttcaggcagcactggaaacaatacagactcaggagatcagggaagtcattttgcaaagaagcagaagtgtcaggaggtagcacctgtaaggatgaatgctggagctgtctcatggagtttcacagaaaggtaacaagctgcacaatgactgtctaggggcaacagatacataggaggaaagcagtcttcattcaaacaggatactgagattgacatagtgtgtcttccaacaagataagcaaaagtatgtgaagaaatgagtccctaaaggaaaatatctctttgggcaatttcacttcaattcaatttcatgttaaatacaaaatacatatattgaatatgtggataaaatcactagaatatattcgtgcaataacatctacgtgagacatgacagcatctcaccatgtctggcagtctctcggggtcaaatgcaatctctgccccccacctggcagtcatcggcacttatggaataggccaggcagaaggctctgttagatactgccttcttcccttcgcaatgcactgtcccagacttcctggggtgagagaagtgattgtctatgagagctagcttggagtgaatgaaaacagcatttaagaggctcagcattttctgatcgccaaagggggtacccttcaacatgaggtgacccagcaatgattggctgctgagttctttgagtattttagggacctgcaggagatctgggtggagctgtgggtttccgtgtgtacagtgtgtaaacatcaccctttggtgcttcgccagtgcttaaggggctcccaggtgctatttattttgtttagtttattgttcagtgttattgtttgttgacttgatctatttttttttctcctacaaaggggccagtctgcaaggacacatcctgtagatggctaattgatgatgccctattgtttagtgtgtgtgcactgtggttttatttgcttcggttcaaagggcctaaacaatgcattcgttggaatttagtaactgctgtaaaatcagcacagagaacaatctgtgagctgatattttttgtacccaaatctggtaatctctgcttgactaaagaaagcaaaatctaaaatgacctttcaactaaccatagaaaaggccttccattgaatctcaaagagacttatttttctaccaaatataaaaacattcgaattatgcatcattttccatgattcaaaggagacagaggtgcctacggggcatgttactcatagacaagtctattctagtctaatcacgtccccttaaaaatcaccgagtagatgacaccgaggatgagaacgaggtactgtaatcattactttagaaactttatatttttacctgtttcaagacagaattctcctagaaaatctggagcaacaagcttattccccttggagaggagataacgaataatggaccacgcattcggagagaggaagtttccactgggagcccttcctgcatcagtgcgtctctggttgggctggctatctgtgtaggaagtgaacgcaggaagtatctgtctacaaaccctttatcctcaaggtaattgctgtagcagcattttactgtttaccaaagcagtaaacatgtgatctaaaaaaagatgttttccatctccagaagaacaaggctttaaaaaatgtatacatgtgcttattttgtaaccagcttatcaaaattggttacaataggcttgggctttcaacagtgagtccatgaaaacagctcttgggatggacagaggtaccctcacagggatgcacaagaaacaaagaagtggcttccttcactagaatgctatcctagcaacacacattttatgtcttttctcctaagaccggcttaaccgagttcatactgtttggcttacaaagaaggtaaagtcaacaaaactatctatgttaattcaggttggtagaatgagtaattcacaaagtccaataactcataaaagtcacttacatttggccttggacaatattcttatttttacgtgactataaatatgcttccagtttaggagttcacacaagacaaagtgaaaagttagaactcaaaaggagatgtgtagtggctgcttttgctgacttttgcctggcgtaggccaagcctcctggtccgtcttttcctttgtttctttattccagatcaagcttgcaaacctgcaccgtcccagatttcctggggtaagagaagtgattgtctaggagaggcagcttggaatgaataaaaacaggtccaggaaggatccctcagcatttaagaggctcaggaggggtccccctcatcatccttgttgtcttttgtgtttttcaagccgccttccaggtggatagcgattgcaatgagagagaaagagtatggaaggagaataagaagaatagggagacacagaagttaacaacgccctgaatgtctccttccaggacctgctgtgcagtgtccggtgaactcaccagcaagcatttcccagccctgttttaagcaatctccaatgcagatcaggtgctcgtgaataattgggagctcactgtgtctgtcagagttcttactttataatgaagagataaaaacatgttcatcacaggaaaatggacaaattggctaattgaaaacaaaattcaattcacaaactgttgtagaaattgaaaaaaaaaaggtagggggaaatgcttttcatagattccctgattttagtcttagaagaaaaatgtatttggcttgaatgaatagtaaaattaactaactttgattgaggagcttatgtgtgccatatacagttctgggctcttgcgacttggtgaatctcactataaccctgtgaagtaggaactatcactctacccatttcaccgatggaaaagcctatctcctgtgaggctgtggcttgccaaaggtgaaatggccaggaagtagaacagccagggagtgaaccccaaaagccaggtgggagcccatttcccctgcccactgcacgagacccctccccggtttgaagatccgataggggcactgctgttagctccccctgcgtcctggcagcagcacagtcagcagatggtcactgtggagaaggcggagctgaccacctccattttcctataagggagctagggccaggagaggtgcgttcacctggggaagtcctgcagcatcaaactaaagctccgggccaccctctcccagatgggcctctttccacttccccttgccagcagctatatctatgcctcccatccgttgcacggaagataaggccaatcccttttccacagaggctattttaaggatgccacgaagaaatacagagtaccaagtgcctccctgggccaaagataaaagtgggctgtgctctctggattcaaccttcatgtttttgatgctctctggaaggtcagggaaggcacacatatcgtatggatccaaagaggactacgcaatgcaaaaccacatactttttttttctttttaacttggagcaatgtcttgggacatctacctcaaattgagacacaaactaattgtgttgacagattctaaagtgttgtttcaacagtttcttcttcctcaaaggtgagcatcatgtgcacactgtcaaaattaaaaaaaaaaaaaaaaagacccaataaaacccgatgaaacccaaagagcatggagatgagaaactcactgctggctgacgatctgaatgaatggccttggggggaatgtgaatgtggaggtagcagaagggtcctgtcttcagtgcttgattctgtatcaatacttggtaaatttaaaaaacaaaaaaaccagcaagggagattttaaatcatcaaggcagaaggatttaaaaagtggaatgtgttaaatgcaagagtgcgggatctttgcataaagttattatattttcaaaaattcgacaagcattgtttttaccaaacgtgtttaaagtaacagccctgaggttaatgttatgattggattctgatgtggcactttaaaaataaatcattttgcttggccttagcatttcttttcaaaatgtctctgtacttatctgtgtacaacagcagattaccgttcttcccagagtttaattccatgaacaccctgctgaaagacttgttaaggccttatggaaaactctgacctgcgtgttcattattgacgcccaagacgagtgcaaggaagttgatacttgggatgaggaaatttaaatcagcagctgatctggaatctggaagcactgccccttggatctcgccaaatatggaaagaattcttgtcactgagcaaatatagaattcagtgctagagttttacctcttgaattttctagaactttgttttgattagccacctagagtataagaattgctgcctatgggatttttcccagaagagtagataacataaagtaaccagcgataataattttcattatccaattatttcatgtgtctccataacacttaatacatcatgtttctctgcacagtaattcactatgtacagctagggtgaatagcaggaaaaaagagatcagatgataaagagaagggagacagatttgtgtgacttgtataagatacttcgcctctctaatcctttgtccttatctgtaagaaagcagcagtacccaggctgctgtgaggatcacatgagacattatgagagtttagcacaggacttggcacataacaagcagttattaggatgatgttagtttggattatgaattcaagatactacagctacattttttatactttcttaaacatcaatttaagtcaattttaattaacgttattttactaggagaaatgtctctaaaaacataagaattctatttgaagtctacaatgataattacattactctgatatcttaacttcctctttatgatttcaaataattaaaatttaagtttatgttttcaacaagtgcttattgaacctctactctttgccagtcactgttgaggacacagaagaaatggataagatatcactaaaaacagcttctgcgatatcagtgggtatacataaattattcacactcaacaacaaacacaagcaaagctgggagaatgtgctgacaggaaagaaaatgaagagtgggagagtggacagatgggaatcgatgtgaaattttataaaacatgtcttggccaagctcagtaggggaaatatgtggaaagtaagctagaccaaacagagaataaaagtataaataagaaaaaaaatccagaggtcacagtggaccactagccaaaatgggttcacagcaaacaaacaaaaaaatgtaatgaaatactaaaattaaagaagtacaaataaaaatgagattctgttcttatctgtcagaatggcaaagattcaaagagtaaaatattcagagttgttatgggtgtagtgtggaactggtctcatatgtggctagaaaaagggagaactggtataatccttccagagaataatctggtaattattttttaaattggcaaatatttaaatttggcaaagacttaaaaaatatatatacccattggctcaataattcctttctaggcaccaatactaataaaaagtattcaaaaaattaaatagatggtgtactgcaatataatgagtgaaacatcgcaagcagcatcactttatacactaggatattggttataaaatggtaatacatattttagatagaatataatgaaacaaaaattttgcttatcaaaaaatgttagtaacatgggaaaatgcttgtaaaacaatgctaactgagaagagcaggacaggtaggtagatacaaggccaaacagatacacacggtggagagacatatcccaattgttaggaatttgctgtggttggttaggatctgaacaatttatattgactttgtgatgacttttaaacgttttctctaccataagaattttttatgtttataatttatgctaaagaacaagatgtattttttgtaattcaggagtaaagaggagagtggggtattccagggtgctgttcctgccctaaccaggagcacgatgcagtcataggcctctgccctcctccagcagcctcggctcagaacaggacgaagccaaccctctctgaccagcaccacctcgggcgacccctggacgctccacctgcccctgtgtgtggtacctgccctgctacacctttaacaagcacccctgcaagctccctcctccttccttccctgtcctgtggctgcccagacccagatgtaccctgcctgggtgtgggaggccgcacatcagagcagtctatggctgtgggcttcacagctgaagctgggccgtgggaaatgttgagacgagtgagtgcagagcctgaaagacaatacggtagaaaaggttacatccgcgggggggcgtctgatggcatctgccatttattgaggatgggtgcgagacagggtagccattatgatcccattttacaggtgacgaaactgagatcagacaggctagctaccttgcccagggtcacaacaggaaggaagcaaatgcaagtgtgtctgcggccacgtaaggtgagagaagcgctatcaggggtggtctgacagaatccccaggccagggagcagttgtcctctatcctgtggggtcaaaggaggggacaagaaggctctccttgaggtagctccaaagaaaagaccccgccagagcacagtgtgctaccaaacgctggaacagcctggagactgtccctgtctcttctctgaggtttctcatttcagagaaactctcatccgtctggcttccccatggcccttactctgtgattctcttatgtatcagctgttaaaccaataaatccgccaaattgttgggatgcctataatggctttgggtctccactcccacagagggaatcttattctaaagttctaaatgtatcagtcatattttcctgaagacaacagaaatggttgtttcatttacttatttttatgtatgctttttcaagagttgttaacctgtgtttgtgtttaaataaagatctgttttgcaaaacaaaaactttatgagataatcacttataaacgtagataattaagaaatggttcaggctcagcacattgtctgagagcattgcagtcctgcactgtatttcatgggggaagaaaagcccacagatggagccattctcaatcctgctttccagggtcactgagtcagggtgcctggcatgcatgggtgcatgcacacacaggcagagggccagggagaactgtgctgtgtccacagagggcagcctggatcacagagctgaccaagaacggaagcagcaagttgttttaaagtagttgcctgtaaagccacttttcggcaaggacaaacactcagagcatgctctgaaatgacttatgcacagcagggcagcggcattttgcccctggccttccttccattctcccggaatccccctaaagtaacaaggactgacgcaattcgtatttcacttagccaacaggttgatgaaaaatcataaatctgtagctattaaactcattaatcacatccatcaaaattctgtgaggagttaactttcttcatataactcttagtcttaattaagtttccctcacatgtgatagcaaacgttcaagaagtgcaaatgtgcagacgtggcgtatataatgcaagctttatgtctttaaattaataaaattgagtcctatcaggtcgtgtttcaattaccatcaaaccttccaacctctgttaattcaaaaaaaagtaacttctttaggcaagtcatggaaatagcactagggtgccctcaggtctccaccaagccttgttagtaactttccatgtcctgtctgatttttaagatgctttcccctgatgctgctgccggctgctggctctctccacatccttcaatgtcagatctctgtgatgatggaaaatcccccacattccctttttacacattaagtatctttctaggatcagaacttgcaacctggggttcatgttctccttaaaaggtccggggagaggactgtatttctgttgtaattctatgtatttctttttaggcaccagaaagtattattctgagaaaggactgtaggcttcactagacttcccaaattgcagatggcattaaaaaaaaaggaatcaggaaagtctttgggaaattaggctaaaactcctaactgaagcacaatcgagttttcagtgcaacagcaggatccctgcagtctgtagcaaacactgagatgtttgtggggacagtggggccggtgaggttcagcacctctcaatattgtcagatgtcaccaatgcccaagggaagcaccaaaaccaatcagtgaattgtctgcaaaccatcagctttgttgcttccaagtctttactagaactcttaagctgatcttaaaattcacagacacttagagataaatgaacactctcacataagttcccaaaattcctttacttcttccaattgaaacattttgttcccaatttcaagttaccaagggaaaatgatggtaagaatcacaaagactggatacgaatatttagcttttcatagtgtctcatagggtcttacaaatgttaatgcaaaaaaataaaaactccactcaaatgcagaaaaccaacttaaaaaattcagagcatctgatacctaatcgactaattgatttatttactgaaacaacaaaaaaacagagtgcattgagactggaaattgcctctatggggggctgtttcctaattccagtggacagccatcattttccctatgctaacttgggctttgcgctaacgtaattgaaactgtagtcaacagactcaggacctcctttttccactctataaacaaggctgtaaaatcatctcattactttacccaggaaatctaacagaaacatgtcttaaaggaagtcacctataaagagggcctattttaacagaagattaaaaaaaaattcacctgtagtcattctaagggttcacttgggtacatacaataaacacataatgcaatgtaataaaatgttaaatcaagcatagtaccttagacaagtgtaaactattatttccaaaaaagtgttcagaaaatcacaaaatattcaaactttcaaaatagcttcatgtattcataaatgtatacttcaaattaaacagtataacacatttggatgttttgcaaaatgtacctaccttctaaaggatggtctgttatttcaatgtcctttttaatgcactgagttttttgggaaaaaaaaccacataagatcgtacccaagctattcaagatttacacagaatatttgatttaacatgcatatgaataaggatgaaaataagaacaaaaaaataacattttgggtcacaaaatcaagtaatttctattcatgtagctataagtagggcacattaactctcaattttataattcctgtctataggagccatatttcagcagattccaatccttgaagccaaagaaagaaaagtataaggtgaaagttcttggtacacagatttttaatatattattgaacacaccttgagaaataaaagctgaacttctcaaacacagtttctatggtacatatgagtcaaatcttctaatacaaacatttcaaattatgaaaataccaaaccaaagagtatttttgaaaatggcttggcccaattctgggcaaacttccattttcttatgcactttccaacaaactaaaagccttatgaaaacaccaccaaatgcttctcacctccgtgcagcaaaactaaagacatgcaacaaacacaattttcttttccctccactcagcatctgcttttgttgctgatttttcacatttctacaaatgtcacgaaggcatggtggcctttaaaacaactgaacggacccccattcaagactgcatgccccttgacttgtagtcaccattaaattggcttcatttccaggaatcaggccatatttaggattgtacctgtgcagatttacctccacattaatctctacatgctatctactaaaaacttaggcaaggaaatgcatcagaccaaacaccccacagcacagagaaccgaccggccattgctttccaatctccgcaaacctaaccattgctggaagaaatcttactcacagtgcacagacagtaggtattttattgaagataaacatatagtggaacaaaccaaattacccccatttgagttacgtgagcactcagttctcagcgtggatgtcccacaaatcaagtcaacatttgcgtcccattaccagcagccacttgccgagtatctcttcgcttccactgggactgcctggcatccctgatgctaaggagccactgaagagcctccaaatgtctgacattcacaaacgcatcttttgctttgacccgacccttcaacctctccgagtctgctgccttttctcagacacacatccaggcaccgttagggatagttagagaatctgaaaattcagaagcgctccgaaaagcctttccaaaagtaatccacagcactcaacagtgaatttagaaaccccaatttttttctgagtttgaagtttttaagccttgcggatggttggagtaggaaaaaggaaatttactaggcagtgcaaaggaaatcttgttgtcctctattgtggcagtgggggtgttgcccaaccctaacttatctgccttgataaaggaaaccaaagaaaagagtaacaagaacaagattttgtcaaattaaaaggaaccctttccttaccttaatagtgctggccataatgcgatcaagtttattgatcgttaataaatgttaataataattattgcttctctctgaccagaaagtagttttgatgaggttgtttagagcggatgagattgtgctaagtctgggaaatgaa

SEQ ID NO: 2640 - DNA, 118480 bp, Homo sapiens; identical to SEQ ID NO: 2639

SEQ ID NO: 2641 - DNA, 24 bp, Homo sapiens
taaaggtgctaagtctacatgtaa

SEQ ID NO: 2642 - DNA, 56 bp, Homo sapiens
ttactgctcattgacaatgctttgaggggctgaggtaaatatcattttatcattgg
